US008343510B2

(12) United States Patent  
Senn et al.

(10) Patent No.: US 8,343,510 B2
(45) Date of Patent: Jan. 1, 2013

(54) **PROTECTIVE PROTEINS OF *S. AGALACTIAE*, COMBINATIONS THEREOF AND METHODS OF USING THE SAME**

(75) Inventors: Beatrice Senn, Vienna (AT); Eszter Nagy, Vienna (AT); Andreas Meinke, Pressbaum (AT); Alexander Von Gabain, Vienna (AT); Barbara Maierhofer, Niederabsdorf (AT); Ulrike Stierschneider, Vienna (AT); Manfred Berger, Wiener Neustadt (AT); Christina Neubauer, Wiener Neustadt (AT); Katherine Cohen, Vienna (AT)

(73) Assignee: Intercell AG, Vienna (AT)

( * ) Notice: Subject to any disclaimer, the term of this patent is extended or adjusted under 35 U.S.C. 154(b) by 362 days.

(21) Appl. No.: 12/522,636

(22) PCT Filed: Jan. 10, 2008

(86) PCT No.: PCT/EP2008/050227
§ 371 (c)(1),
(2), (4) Date: Nov. 18, 2009

(87) PCT Pub. No.: WO2008/084072
PCT Pub. Date: Jul. 17, 2008

(65) Prior Publication Data
US 2010/0129388 A1    May 27, 2010

(30) Foreign Application Priority Data
Jan. 12, 2007  (EP) .................................... 07000602

(51) Int. Cl.
*A61K 39/09* (2006.01)
*C07K 14/315* (2006.01)
*C12P 21/04* (2006.01)
(52) U.S. Cl. .................. 424/244.1; 424/190.1; 530/350; 435/69.7
(58) Field of Classification Search .................. None
See application file for complete search history.

(56) References Cited

U.S. PATENT DOCUMENTS

| 4,946,778 A | 8/1990 | Ladner et al. |
| 7,485,710 B2 * | 2/2009 | Reinscheid et al. ......... 536/23.1 |

FOREIGN PATENT DOCUMENTS

| GB | 2188638 A | 10/1987 |
| WO | WO 86/01533 | 3/1986 |
| WO | WO 90/07861 | 7/1990 |
| WO | WO 91/18088 | 11/1991 |
| WO | WO 96/02555 | 2/1996 |
| WO | WO 01/24822 A2 | 4/2001 |
| WO | WO 01/54720 A1 | 8/2001 |
| WO | WO 01/78767 A2 | 10/2001 |
| WO | WO 01/93903 A1 | 12/2001 |
| WO | WO 01/93905 A1 | 12/2001 |
| WO | WO 02/13857 A2 | 2/2002 |
| WO | WO 02/32451 A1 | 4/2002 |
| WO | WO 02/34771 A2 | 5/2002 |
| WO | WO 02/095027 A2 | 11/2002 |
| WO | WO 03/047602 A1 | 6/2003 |
| WO | WO 2004/035618 A2 | 4/2004 |
| WO | WO 2004/099242 A2 | 11/2004 |
| WO | WO 2005/010167 A2 | 2/2005 |
| WO | WO 2006/130328 A2 | 12/2006 |

OTHER PUBLICATIONS

Houghten et al (Vaccines, 1986, Edited by Fred Brown: Cold Spring Harbor Laboratory).*
Abubakar et al., "Primary and Secondary Immune Response to Formalin Inactivated *Streptococcus agalactiae* Isolates in Rabbits" (2006) *Pakistan Vet.* 1 26(3): 115-117.
Altschul et al., "Basic Local Alignment Search Tool," (1990) *J. Mol. Biol.* 215: 403-410.
Amit et al., "Three-Dimensional Structure of an Antigen-Antibody Complex at 2.8 Å Resolution," (1986) *Science* 233: 747-753.
Brochet et al., "Genomic Diversity and Evolution Within the Species *Streptococcus agalactiae*", (2006) *Microbes and Infection* 8: 1227-1243.
Brodeur et al., "Identification of Group B Streptococcal Sip Protein, Which Elicits Cross-Protective Immunity," (2000) *Infect Immun.* 68(10): 5610-5618.
Carter et al., "Improved Oligoneucleotide Site-Directed Mutagenesis Using M13 Vectors," (1985) *Nucl. Acids Res.* 13(12): 4431-4443.
Cohen, "Naked DNA Points Way to Vaccines," (1993) *Science* 259: 1691-1692.
Dramsi et al., "Assembly and Role of Pili in Group B Streptococci", (2006) *Molecular Microbiology* 60(6): 1401-1413.
GenBank Accession No. AAJO00000000, dated Jan. 17, 2007.
GenBank Accession No. AAJP00000000, dated Jan. 17, 2007.
GenBank Accession No. AAJQ00000000, dated Jan. 17, 2007.

(Continued)

*Primary Examiner* — Padma Baskar
(74) *Attorney, Agent, or Firm* — Wolf, Greenfield & Sacks, P.C.

(57) ABSTRACT

The invention relates to a composition comprising at least two protective proteins against *Streptococcus agalactiae* (*S. agalactiae*) or functionally active variant thereof; a protective peptide against *S. agalactiae*; one or more nucleic acid(s) encoding the at least two proteins and/or the protective peptide; a method of producing the composition; a pharmaceutical composition, especially a vaccine, comprising the composition and/or at least one protective peptide; methods for producing antibodies; a mixture of antibodies against the at least two proteins of the composition; the use of the composition and/or at least one protective peptide and/or one or more nucleic acid(s) for the manufacture of a medicament for the immunization or treatment of a subject; methods of diagnosing a *S. agalactiae* infection; a method for identifying a ligand capable of binding the composition and/or at least one protective peptide; and the use of the composition and/or at least one protective peptide for the isolation and/or purification and/or identification of an interaction partner of the composition and/or peptide.

15 Claims, 19 Drawing Sheets

OTHER PUBLICATIONS

GenBank Accession No. AAJR00000000, dated Jan. 17, 2007.
GenBank Accession No. AAJS00000000, dated Jan. 17, 2007.
GenBank Accession No. AE009948, dated Oct. 24, 2008.
GenBank Accession No. AL732656, dated Nov. 6, 2010.
GenBank Accession No. CAD12883, dated Nov. 14, 2006.
GenBank Accession No. CAD27181, dated Nov. 14, 2006.
GenBank Accession No. CAD27182, dated Nov. 14, 2006.
GenBank Accession No. CAD27183, dated Nov. 14, 2006.
GenBank Accession No. CAD27186, dated Nov. 14, 2006.
GenBank Accession No. CAJ66788, dated Sep. 18, 2006.
GenBank Accession No. CAJ66790, dated Sep. 19, 2006.
GenBank Accession No. CAJ66794, dated Sep. 19, 2006.
GenBank Accession No. CAJ66802, dated Sep. 19, 2006.
GenBank Accession No. CP000114, dated Mar. 11, 2010.
Huse et al., "Generation of a Large Combinatorial Library of the Immunoglobulin Repertoire in Phase Lambda," (1989) *Science*, 246:1275-1281.
International Search Report for International Patent Application PCT/EP2008/050227, mailed Jul. 21, 2009.
Ishibashi et al., "Hypercholesterolemia in Low-Density Lipoprotein Receptor Knockout Mice and its Reversal by Adenovirus-Mediated Gene Delivery," (1993) *J. Clin. Invest.* 92: 883-893.
Johri et al., "Group B *Streptococcus*: Global Incidence and Vaccine Development," (2006) *Nature Reviews* 4(12): 932-942.
Kay et al., "In Vivo Hepatic Gene Therapy: Complete Albeit Transient Correction of Factor IX Deficiency in Hemophilia B Dogs," (1994) *Proc. Natl. Acad. Sci. USA* 91: 2353-2357.
Maione et al., "Identification of a Universal Group B *Streptococcus* Vaccine by Multiple Genome Screen," (2005) *Science* 309(5731): 148-150.
Maisey et al., "Group B Streptococcal Pilus Proteins Contribute to Adherence to and Invasion of Brain Microvascular Endothelial Cells," (2007) *Journal of Bacteriology* 189(4): 1464-1467.
Mancini et al., "Phase Display for the Production of Human Monoclonal Antibodies Against Human Pathogens," (2004) *New Microbiol.* 27(4):315-328.
NCBI accession No. NC_004116, dated Mar. 31, 2010.
NCBI accession No. NC_004368, dated Feb. 14, 2011.
NCBI accession No. NC_007432, dated Mar. 21, 2010.
NCBI accession No. NZ_AAJO00000000, dated Feb. 3, 2010.
NCBI accession No. NZ_AAJP00000000, dated Feb. 3, 2010.
NCBI accession No. NZ_AAJQ00000000, dated Feb. 3, 2010.
NCB I accession No. NZ_AAJR00000000, dated Feb. 3, 2010.
NCB I accession No. NZ_AAJS00000000, dated Feb. 3, 2010.
Pearson and Lipman, "Improved Tools for Biological Sequence Comparison," (1988) *Proc. Natl. Acad. Sci. U.S.A.* 85: 2444-2448.
Pini et al., "Strategies for the Construction and Use of Peptide and Antibody Libraries Displayed on Phages," (2004) *Curr. Protein Pept Sci.* 5: 487-496.
Queen et al., "A Humanized Antibody that Binds to the Interleukin 2 Receptor," (1989) *Proc. Natl. Acad. Sci. USA* 86: 10029-10033.
Rammensee et al., "SYFPEITHI: A Database for MHC Ligands and Peptide Motifs," (1999) *Immunogenetics.* 50: 213-219.
Riechmann et al., "Reshaping Human Antibodies for Therapy," (1988) *Nature* 332: 323-327.
Rosini et al., "Identification of Novel Genomic Islands Coding for Antigenic Pilus-Like Structures in *Streptococcus agalactiae*," (2006) *Mol. Microbiol.* 61(1): 126-141.
Santi et al., "BibA: A Novel Immunogenic Bacterial Adhesin Contributing to Group B *Streptococcus* Survival in Human Blood," (2007) *Mol. Microbiol.* 63(3): 754-767.
Schubert et al., "The Fibrinogen Receptor FbsA Promotes Adherence of *Streptococcus agalactiae* to Human Epithelial Cells," (2004) *Infection and Immunology* 72(11): 6197-6205.
Smith and Waterman, "Comparison of Biosequences," (1981) *Adv. Appl. Math.* 2: 482-489.
Tettelin et al., "Genome Analysis of Multiple Pathogenic Isolates of *Streptococcus agalactiae*: Implications for the Microbial 'Pan-Genome'," (2005) *PNAS* 102(39): 13950-13955.
Wells et al., "Cassette Mutagenesis: An Efficient Method for Generation of Multiple Mutation at Defined Sites," (1985) *Gene*, 34: 315-323.
Wells et al., "Importance of Hydrogen-Bond Formation in Stabilizing the Transition State of Subtilisin," (1986) *Philos. Trans. R. Soc. London SerA* 317: 415-423.
Zoller et al., "Oligonucleotide-Directed Mutagenesis using M13-Derived Vectors: An Efficient and General Procedure for the Production of Point Mutations in any Fragment of DNA," (1987) *Nucl. Acids Res.* 10: 6487-6500.
EP10010877.8 Extended European Search Report mailed Jul. 11, 2012.
EP10010878.6 Extended European Search Report mailed Jul. 11, 2012.
EP10010879.4 Extended European Search Report mailed Jul. 11, 2012.
EP10010880.2 Extended European Search Report mailed Jul. 11, 2012.
EP10010881.0 Extended European Search Report mailed Jul. 11, 2012.

* cited by examiner

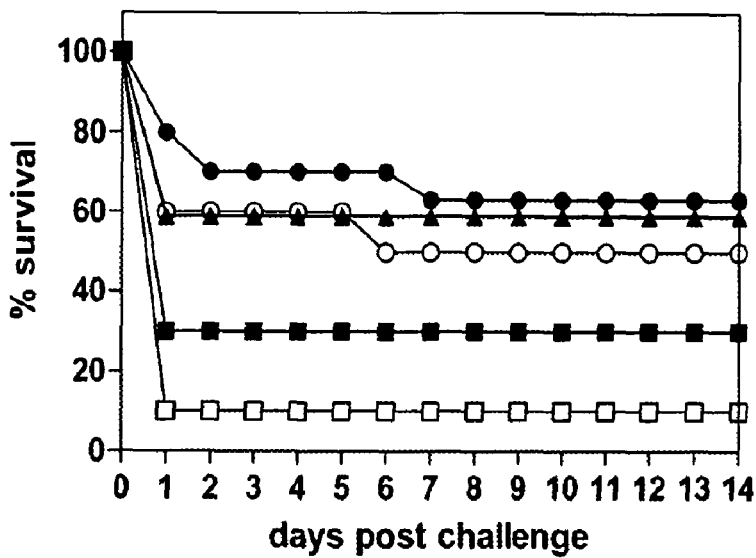
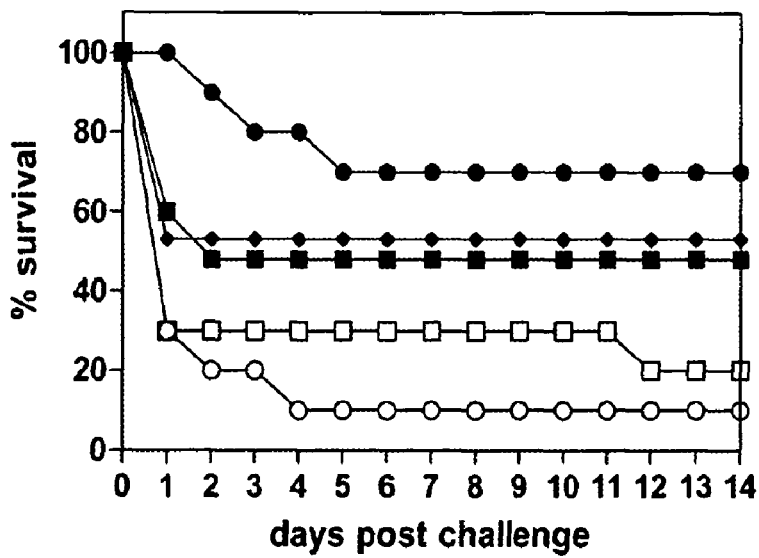
Figure 1

A
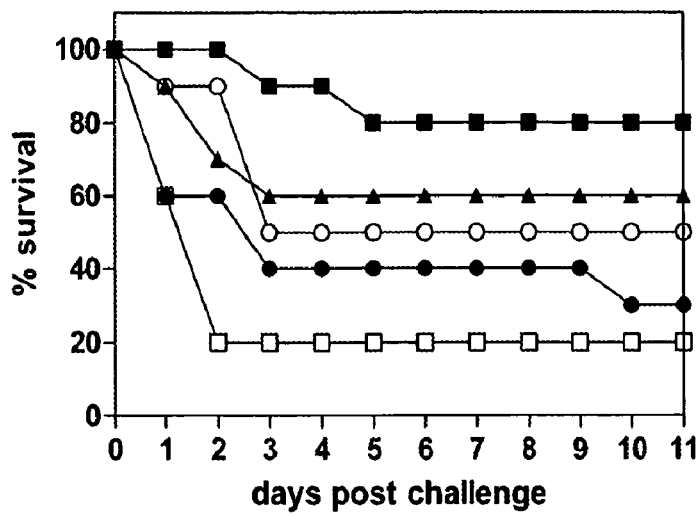
B
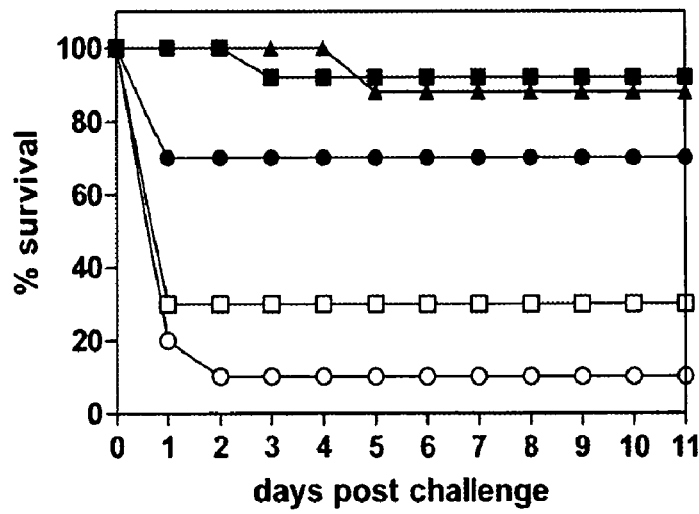
- ● gbs1477p + gbs2018p
- ▲ gbs1087p + gbs1477p + gbs2018p
- ■ gbs1087p + gbs1477p + gbs1478p + gbs2018p
- ○ Sip
- □ PBS
Figure 2

- gbs1477p + gbs2018p
▲ gbs1087p + gbs1477p + gbs2018p
■ gbs1087p + gbs1477p + gbs1478p + gbs2018p
○ Sip
□ PBS

```
                         1                                                  50
    NEM316     (1)  MKKINKCLTVFSTLLLILTSLFSVAPAFADDV--TTDTVTLHKIVMPQAA
    CJB111     (1)  MKKINKCLTMFSTLLLILTSLFSVAPAFADDA--TTDTVTLHKIVMPQAA
    BAA23      (1)  MKKINKCLTMFSTLLLILTSLFSVAPAFADDA--TTDTVTLHKIVMPQAA
      515      (1)  MKKINKYPAVFSALLLTVTSLFSVAPVPAEEAK-TTDTVTLHKIVMPRTA
    0176H4A    (1)  MKKINKFFVAFSALLLILTSLLSVAPAFAEKEK-TTETVTLHKILQTDTN
    12401      (1)  MKRINKYFAMFSALLLILTSLLSVAPVPAAEMGNITKTVTLHKIVQTSDN
    H36B       (1)  MKRINKYFAMFSALLLILTSLLSVAPVPAAEMGNITKTVTLHKIVQTSDN
    IC105      (1)  MKRINKYFAMFSALLLILTSLLSVAPVPAAEMGNITKTVTLHKIVQTSDN
    2603V/R    (1)  MKRINKYFAMFSALLLTLTSLLSVAPAFADEA--TTNTVTLHKILQTESN
    18RS21     (1)  MKRINKYFAMFSALLLTLTSLLSVAPAFADEA--TTNTVTLHKILQTESN
    IC458      (1)  MKKINKYPAVFSALLLTVTSLLSVAPAFADEA--TTNTVTLHKILQTESN
    Consensus  (1)  MKKINKYFAMFSALLLILTSLLSVAPAFADEA  TT TVTLHKIVQT AN
                         51                                                 100
    NEM316    (49)  FDN-FTEGTKGKNDSDYVGKQINDLKSYFGSTDAKEIKGAFFVFKNETGT
    CJB111    (49)  FDN-FTEGTKGKNDSDYVGKQINDLKSYFGSTDAKEIKGAFFVFKNETGT
    BAA23     (49)  FDN-FTEGTKGKNDSDYVGKQINDLKSYFGSTDAKEIKGAFFVFKNETGT
      515     (50)  FDG-FTAGTKGKDNTDYVGKQIEDLKTYFGSGEAKEIAGAYFAFKNEAGT
    0176H4A   (50)  LKNSAFPGTKGLDGTEYDGKAIDKLDSYFGND-SKDIGGAYFILANSKGE
    12401     (51)  LAKPNFPGINGLNGTKYMGQKLTDISGYFGQG-SKEIAGAFFAVMNESQT
    H36B      (51)  LAKPNFPGINGLNGTKYMGQKLTDISGYFGQG-SKEIAGAFFAVMNESQT
    IC105     (51)  LAKPNFPGINGLNGTKYMGQKLTDISGYFGQG-SKEIAGAFFAVMNESQT
    2603V/R   (49)  LNKSNFPGTTGLNGKDYKGGAISDLAGYFGEG-SKEIEGAFFALALKEDK
    18RS21    (49)  LNKSNFPGTTGLNGKDYKGGAISDLAGYFGEG-SKEIEGAFFALALKEDK
    IC458     (49)  LNKSNFPGTTGLNGDDYKGESISDLAEYFGSG-SKEIDGAFFALALEEEK
    Consensus (51)  L K NFPGT GLNGTDYVG  ISDLA YFG G SKEI GAFFAL NES T
                         101                                                150
    NEM316    (98)  KFITENGKEVDTLEAKDA-----------EGGAVLSGLTK--DTGFAFN
    CJB111    (98)  KFITENGKEVDTLEAKDA-----------EGGAVLSGLTK--DNGFVFN
    BAA23     (98)  KFITENGKEVDTLEAKDA-----------EGGAVLSGLTK--DNGFVFN
      515    (99)  KYITENGEEVDTLDTTDA-----------KGCAVLKGLTT--DNGFKFN
    0176H4A   (99)  YIKANDKNKLKPEFSGNT--------PKTTLNISEAVGGLTEE-NAGIKFE
    12401    (100)  KYITESGTEVESIDAA----------------GVLKGLTT--ENGITFN
    H36B     (100)  KYITESGTEVESIDA---------------AG--VLKGLTT--ENGITFN
    IC105    (100)  KYITESGTEVESIDAA----------------GVLKGLTT--ENGITFN
    2603V/R   (98)  SGKVQYVKAKEGNKLTPALINKDGTPEITVNIDEAVSGLTPEGDTGLVFN
    18RS21    (98)  SGKVQYVKAKEGNKLTPALINKDGTPEITVNIDEAVSGLTPEGDTGLVFN
    IC458     (98)  DGVVQYVKAKANDKLTPDLITK-GTPATTTKVEEAVGGLTT--GTGIVFN
    Consensus(101)  KYITE GKEVETLDA  A              AVL GLT   DNGI FN
                         151                                                200
    NEM316   (134)  TAKLKGTYQIVELKEKSNYDNNGSILADSKAVPVKITLPLVNNQGVVKDA
    CJB111   (134)  TAKLKGIYQIVELKEKSNYDNNGSILADSKAVPVKITLPLVNNQGVVKDA
    BAA23    (134)  TAKLKGIYQIVELKEKSNYDNNGSILADSKAVPVKITLPLVNNQGVVKDA
      515   (135)  TSKLTGTYQIVELKEKSTYNNDGSILADSKAVPVKITLPLVNDNGVVKDA
    0176H4A  (141)  TTGLRGDFQIIELKDKSTYNNGGAILADSKAVPVKITLPLINKDGVVKDA
    12401    (131)  TANLKGTYQIVELLDKSNYKNGDKVLADSKAVPVKITLPLYNEEGIVVDA
    H36B     (131)  TANLKGTYQIVELLDKSNYKNGDKVLADSKAVPVKITLPLYNEEGIVVDA
    IC105    (131)  TANLKGTYQIVELLDKSNYKNGDKVLADSKAVPVKITLPLYNEEGIVVDA
    2603V/R  (148)  TKGLKGEFKIVEVKSKSTYNNNGSLLAASKAVPVNITLPLVNEDGVVADA
    18RS21   (148)  TKGLKGEFKIVEVKSKSTYNNNGSLLAASKAVPVNITLPLVNEDGVVADA
    IC458    (145)  TAGLKGNFKIIELKDKSTYNNNGSLLAASKAVPVKITLPLVSKDGVVKDA
    Consensus(151)  TA LKG YQIVELKDKSNY NNGSILADSKAVPVKITLPLVNEDGVVKDA
```

Figure 5A

```
                    201                                                250
      NEM316  (184) HIYPKNTETKPQVDKNFADK---------------DLDYTDNRKDKGVVS
      CJB111  (184) HIYPKNTETKPQVDKNFADK---------------DLDYTDNRKDKGVVS
       BAA23  (184) HIYPKNTETKPQVDKNFADK---------------DLDYTDNRKDKGVVS
         515  (185) HVYPKNTETKPQVDKNFADK---------------ELDYANNKKDKGTVS
      0176H4A (191) HVYPKNTETKPQIDKNFADK---------------NLDYINNQKDKGTIS
       12401  (181) EVYPKNTEEAPQIDKNFAKANKLLNDSD-NSAIAGGADYDKYQAEKAKAT
        H36B  (181) EVYPKNTEEAPQIDKNFAKANKLLNDSD-NSAIAGGADYDKYQAEKAKAT
       IC105  (181) EVYPKNTEEAPQIDKNFAKANKLLNDSD-NSAIAGGADYDKYQAEKAKAT
      2603V/R (198) HVYPKNTEEKPEIDKNFAKTNDLTALTDVNRLLTAGANYGNYARDKATAT
      18RS21  (198) HVYPKNTEEKPEIDKNFAKTNDLTALTDVNRLLTAGANYGNYARDKATAT
       IC458  (195) HVYPKNTETKPEVDKNFAKTNDLTALKD-ATLLKAGADYKNYSATKATVT
   Consensus  (201) HVYPKNTETKPQIDKNFAK N L     D    I AGADY  Y KDKA VT
                    251                                                300
      NEM316  (219) ATVGDKKEYIVGTKILKGSDYKKLVWTDSMTKGLTFNNNVKVTLD---GK
      CJB111  (219) ATVGDKKEYIVGTKILKGSDYKKLVWTDSMTKGLTFNNNVKVTLD---GE
       BAA23  (219) ATVGDKKEYIVGTKILKGSDYKKLVWTDSMTKGLTFNNNVKVTLD---GE
         515  (220) ASVGDVKKYHVGTKILKGSDYKKLIWTDSMTKGLTFNNDIAVTLD---GA
      0176H4A (226) ATVGDVKKYTVGTKILKGSDYKKLVWTDSMTKGLTFNNDVTVTLD---GA
       12401  (230) AEIGQEIPYEVKTKIQKGSKYKNLAWVDTMSNGLTMGNTVNLEASS--GS
        H36B  (230) AEIGQEIPYEVKTKIQKGSKYKNLAWVDTMSNGLTMGNTVNLEASS--GS
       IC105  (230) AEIGQEIPYEVKTKIQKGSKYKNLAWVDTMSNGLTMGNTVNLEASS--GS
      2603V/R (248) AEIGKVVPYEVKTKIHKGSKYENLVWTDIMSNGLTMGSTVSLKASGTTET
      18RS21  (248) AEIGKVVPYEVKTKIHKGSKYENLVWTDIMSNGLTMGSTVSLKASGTTET
       IC458  (244) AEIGKVIPYEVKTKVLKGSKYEKLVWTDTMSNGLTMGDDVNLAVSGTTTT
   Consensus  (251) AEIG   IPYEVKTKILKGSKYKKLVWTDSMSNGLTMGN V L LS  GS
                    301                                                350
      NEM316  (266) DFPVLNYKLVTDDQGFRLALNATGLAAVAAAAKDKDVEIKITYSATVNGS
      CJB111  (266) DFPVLNYKLVTDDQGFRLALNATGLAAVAAAAKDKDVEIKITYSATVNGS
       BAA23  (266) DFPVLNYKLVTDDQGFRLALNATGLAAVAAAAKDKDVEIKITYSATVNGS
         515  (267) TLDATNYKLVADDQGFRLVLTDKGLEAVAKAAKTKDVEIKITYSATLNGS
      0176H4A (273) NFEQSNYTLVADDQGFRLVLNATGLSKVAEAAKTKDVEIKINYSATVNGS
       12401  (278) FVEGTDYNVERDDRGFTLKFTDTGLTKLQKEAETQAVEFTLTYSATVNGA
        H36B  (278) FVEGTDYNVERDDRGFTLKFTDTGLTKLQKEAETQAVEFTLTYSATVNGA
       IC105  (278) FVEGTDYNVERDDRGFTLKFTDTGLTKLQKEAETHAVEFTLTYSATVNGA
      2603V/R (298) FAKDTDYELSIDARGFTLKFTADGLGKLEKAAKTADIEFTLTYSATVNGQ
      18RS21  (298) FAKDTDYELSIDARGFTLKFTADGLGKLEKAAKTADIEFTLTYSATVNGQ
       IC458  (294) FIKDIDYTLSIDDRGFTLKFKATGLDKLEEAAKASDVEFTLTYKATVNGQ
   Consensus  (301) F   TDY L  DDRGFTLKFTATGL KL KAAKT DVEFTLTYSATVNGS
                    351                                                400
      NEM316  (316) TTVEVPETNDVKLDYGNNPTEESEPQEGTPANQEIKVIKDWAVDG-----
      CJB111  (316) TTVEIPETNDVKLDYGNNPTEESEPQEGTPANQEIKVIKDWAVDG-----
       BAA23  (316) TTVEIPETNDVKLDYGNNPTEESEPQEGTPANQEIKVIKDWAVDG-----
         515  (317) AVVEVLETNDVKLDYGNNPTIENEPKEGIPVDKKITVNKTWAVDGN----
      0176H4A (323) TVVEKSENNDVKLDYGNNPTTENEPQTGNPVNKEITVRKTWAVDGN----
       12401  (328) AIDDKPESNDIKLQYGNKPGKKVKEIPVTPSNGEITVSKTWDKGSDLENA
        H36B  (328) AIDDKPESNDIKLQYGNKPGKKVKEIPVTPSNGEITVSKTWDKGSDLENA
       IC105  (328) AIDDKPESNDIKLQYGNKPGKKVKEIPVTPSNGEITVSKTWDKGSDLENA
      2603V/R (348) AIIDNPESNDIKLSYGNKPGKDLTELPVTPSKGEVTVAKTWSDGIAPDGV
      18RS21  (348) AIIDNPESNDIKLSYGNKPGKDLTELPVTPSKGEVTVAKTWSDGIAPDGV
       IC458  (344) AIIDNPEVNDIKLDYGNKPGTDLSEQPVTPEDGEVKVTKTWAAGANKADA
   Consensus  (351) AIVD PESNDIKLDYGNKPG EL E PVTPSNGEITV KTWA GG
```

Figure 5B

```
                        401                                                450
    NEM316    (361)  ----TITDVNVAVKAIFTLQEKQTDGTWVNVASHEATKPSRFEHTFTGLD
    CJB111    (361)  ---TITDANVA-VKAIFTLQEKQTDGTWVNVASHEATKPSRFEHTFTGLD
    BAA23     (361)  ---TITDANVA-VKAIFTLQEKQTDGTWVNVASHEATKPSRFEHTFTGLD
    515       (363)  ---EVNKADET-VDAVFTLQVKDGD-KWVNVDSAKATAATSFKHTFENLD
    0176H4A   (369)  ----EVNKGDEKVDAVFTLQVKDSD-KWVNVDSATATAATDPKYTFKNLD
    12401     (378)  NVVYTLKDGGT-AVASVSLTKTTPNGEINLGNGIKFTVTGAFAGKFSGLT
    H36B      (378)  NVVYTLKDGGT-AVASVSLTKTTPNGEINLGNGIKFTVTGAFAGKFSGLT
    IC105     (378)  NVVYTLKDGGT-AVASVSLTKTTPNGEINLGNGIKFTVTGAFAGKFSGLT
    2603V/R   (398)  NVVYTLKDKDK-TVASVSLTKTSKG-TIDLGNGIKFEVSGNFSGKFTGLE
    18RS21    (398)  NVVYTLKDKDK-TVASVSLTKTSKG-TIDLGNGIKFEVSGNFSGKFTGLE
    IC458     (394)  KVVYTLKNATKQVVASVALTAADTKGTINLGKGMTFEITGAFSGTFKGLQ
    Consensus (401)   VVYTLKD    VVASVSLT     GTI LG GIKFTVTG FAGTFTGLD
                        451                                                500
    NEM316    (407)  NTKTYRVVERVSGYTPEYVSFKNGVVTIKNNKNSNDPTPINPSEPKVVTY
    CJB111    (407)  NAKTYRVVERVSGYTPEYVSFKNGVVTIKNNKNSNDPTPINPSEPKVVTY
    BAA23     (407)  NAKTYRVVERVSGYTPEYVSFKNGVVTIKNNKNSNDPTPINPSEPKVVTY
    515       (408)  NAKTYRVIERVSGYAPEYVSFVNGVVTIKNNKDSNEPTPINPSEPKVVTY
    0176H4A   (414)  NAKTYRVVERVSGYAPAYVSFVGGVVTIKNNKNSNDPTPINPSEPKVVTY
    12401     (427)  DSKTYMISERIAGYG-NTITTGAGSAAITNTPDSDNPTPLNPTEPKVVTH
    H36B      (427)  DSKTYMISERIAGYG-NTITTGAGSAAITNTPDSDNPTPLNPTEPKVVTH
    IC105     (427)  DSKTYMISERIAGYG-NTITTGAGSAAITNTPDSDNPTPLNPTEPKVVTH
    2603V/R   (446)  N-KSYMISERVSGYG-SAINLENGKVTITNTKDSDNPTPLNPTEPKVETH
    18RS21    (446)  N-KSYMISERVSGYG-SAINLENGKVTITNTKDSDNPTPLNPTEPKVETH
    IC458     (444)  N-KAYTVSERVAGYT-NAINVTGNAVAITNTPDSDNPTPLNPTQPKVETH
    Consensus (451)  NAKTY VSERVSGYG   IS  NG VTITNTKDSDNPTPLNPTEPKVVTH
                        501                                                550
    NEM316    (457)  GRKFVKTNQANTERLAGATPLVKKE-GKYLARKAGAATAEAKAAVKTAKL
    CJB111    (457)  GRKFVKTNQANTERLAGATPLVKKE-GKYLARKAGAATAEAKAAVKTAKL
    BAA23     (457)  GRKFVKTNQANTERLAGATPLVKKE-GKYLARKAGAATAEAKAAVKTAKL
    515       (458)  GRKFVKTNKDGKERLAGATPLVKKD-GKYLARKSGVATDAEKAAVDSTKS
    0176H4A   (464)  GRKFVKTNQDGSERLAGATPLVKNSQSQYLARKSGVATNEAHKAVTDAKV
    12401     (476)  GKKFVKTSSTETERLQGAQFVVKDSAGKYLALKSSATISAQTTAYTNAKT
    H36B      (476)  GKKFVKTSSTETERLQGAQFVVKDSAGKYLALKSSATISAQTTAYTNAKT
    IC105     (476)  GKKFVKTSSTETERLQGAQFVVKDSAGKYLALKSSATISAQTTAYTNAKT
    2603V/R   (494)  GKKFVKTNEQG-DRLAGAQFVVKNSAGKYLALKADQSEGQKTLAAK--KI
    18RS21    (494)  GKKFVKTNEQG-DRLAGAQFVVKNSAGKYLALKADQSEGQKTLAAK--KI
    IC458     (492)  GKKFVKVGDAD-ARLAGAQFVVKNSAGKFLALKEDAAVSGAQTELATAKT
    Consensus (501)  GKKFVKTN    TERLAGAQFVVK SAGKYLALKA AA S    AV AKL
                        551                                                600
    NEM316    (506)  ALDEAVKAYNDLTKEKQEGQEGKTALATVDQKQKAYNDAFVKANYSYEWV
    CJB111    (506)  ALDEAVKAYNDLTKEKQEGQEGKTALATVDQKQKAYNDAFVKANYSYEWV
    BAA23     (506)  ALDEAVKAYNDLTKEKQEGQEGKTALATVDQKQKAYNDAFVKANYSYEWV
    515       (507)  ALDAAVKAYNDLTKEKQEGQDGKSALATVSEKQKAYNDAFVKANYSYEWV
    0176H4A   (514)  QLDEAVKAYNKLTKEQQESQDGKAALNLIDEKQTAYNEAFAKANYSYEWV
    12401     (526)  ALDAKIAAYNKLSADDQKGTKGETAKAEIKTAQDAYNAAFIVARTAYEWV
    H36B      (526)  ALDAKIAAYNKLSADDQKGTKGETAKAEIKTAQDAYNAAFIVARTAYEWV
    IC105     (526)  ALDAKIAAYNKLSADDQKGTKGETAKAEIKTAQDAYNAAFIVARTAYEWV
    2603V/R   (541)  ALDEAIAAYNKLSATDQKGEKGITAKELIKTKQADYDAAFIEARTAYEWI
    18RS21    (541)  ALDEAIAAYNKLSATDQKGEKGITAKELIKTKQADYDAAFIEARTAYEWI
    IC458     (541)  DLDNAIKAYNGLTKAQQEGADGTSAKELINTKQSAYDAAFIKARTAYTWV
    Consensus (551)  ALDEAIKAYNKLTKE QEG DG TAKA I TKQ AYNAAFIKARTAYEWV
```

Figure 5C

```
              601                                              650
NEM316   (556) ADKKADNVVKLISNAGGQFEITGLDKGTYSLEETQAPAGYATLSGDVNFE
CJB111   (556) ADKKADNVVKLISNAGGQFEITGLDKGTYGLEETQAPAGYATLSGDVNFE
BAA23    (556) ADKKADNVVKLISNAGGQFEITGLDKGTYGLEETQAPAGYATLSGDVNFE
515      (557) EDKNAKNVVKLISNDKGQFEITGLTEGQYSLEETQAPTGYAKLSGDVSPN
0176H4A  (564) VDKNAANVVKLISNTAGKFEITGLNAGEYSLEETQAPTGYAKLSSDVSPK
12401    (576) TNKEDANVVKVTSNADGQFEVSGLATGDYKLEETQAPAGYAKLAGDVDPK
H36B     (576) TNKEDANVVKVTSNADGQFEVSGLATGDYKLEETQAPAGYAKLAGDVDPK
IC105    (576) TNKEDANVVKVTSNADGQFEVSGLATGDYKLEETQAPAGYAKLAGDVDPK
2603V/R  (591) TDK--ARAITYTSNDQGQFEVTGLADGTYNLEETLAPAGFAKLAGNIKFV
18RS21   (591) TDK--ARAITYTSNDQGQFEVTGLADGTYNLEETLAPAGFAKLAGNIKFV
IC458    (591) DEK--TKAITFTSNNQGQFEVTGLEVGSYKLEETLAPAGYAKLSGDIEFT
Consensus(601)  DK  ANVVKLTSNA GQFEVTGL  GTY LEETQAPAGYAKLSGDV F
              651                                              700
NEM316   (606) VTATSYSKGATTDIAYDKGSVKKDAQQVQNKKVTIPQTGGIGTILFTIIG
CJB111   (606) VTATSYSKGATTDIAYDKGSVKKDAQQVQNKKVTIPQTGGIGTILFTIIG
BAA23    (606) VTATSYSKGATTDIAYDKGSVKKDAQQVQNKKVTIPQTGGIGTILFTIIG
515      (607) VNATSYSKGSAQDIEYTQGSKTKDAQQVINKKVTIPQTGGIGTIFFTIIG
0176H4A  (614) VNDTSYSEGASNDIAYDKDSGKTDAQKVVNKKVTIPQTGGIGTILFTIIG
12401    (626) VGNSSKAD-DSGNIDYTASSNKKDAQRIENKKVTIPQTGGIGTILFTIIG
H36B     (626) VGNSSKAD-DSGNIDYTASSNKKDAQRIENKKVTIPQTGGIGTILFTIIG
IC105    (626) VGNSSKAD-DSGNIDYTASSNKKDAQRIENKKVTIPQTGGIGTILFTIIG
2603V/R  (639) VNQGSYIT--GGNIDYVANSNQKDATRVENKKVTIPQTGGIGTILFTIIG
18RS21   (639) VNQGSYIT--GGNIDYVANSNQKDATRVENKKVTIPQTGGIGTILFTIIG
IC458    (639) VGHDSYTS---GDIKYKTDDASNNAQKVFNKKVTIPQTGGIGTILFTIIG
Consensus(651) V  TSYS   SGDIDY  S KKDAQRV NKKVTIPQTGGIGTILFTIIG
              701       720
NEM316   (656) LSIMLGAVVVMKKRQSEEA* (SEQ ID NO: 223)
CJB111   (656) LSIMLGAVVIMKKRQSEEA* (SEQ ID NO: 224)
BAA23    (656) LSIMLGAVVIMKKRQSEEA* (SEQ ID NO: 98)
515      (657) LSIMLGAVVIMKRRQSEEV* (SEQ ID NO: 225)
0176H4A  (664) LSIMLGAVVIMKRRQSEEA* (SEQ ID NO: 91)
12401    (675) LSIMLGAVIIMKRRQSEEA* (SEQ ID NO: 93)
H36B     (675) LSIMLGAVIIMKRRQSEEA* (SEQ ID NO: 226)
IC105    (675) LSIMLGAVIIMKRRQSEEA* (SEQ ID NO: 103)
2603V/R  (687) LSIMLGAVVIMKRRQSKEA* (SEQ ID NO: 227)
18RS21   (687) LSIMLGAVVIMKRRQSKEA* (SEQ ID NO: 228)
IC458    (686) LSIMLGAVVIMKRRQSEEA* (SEQ ID NO: 127)
Consensus(701) LSIMLGAVVIMKRRQSEEA
```

Figure 5D

PROTECTIVE PROTEINS OF *S. AGALACTIAE*, COMBINATIONS THEREOF AND METHODS OF USING THE SAME

CROSS REFERENCE TO RELATED APPLICATIONS

This application is the U.S. National Stage of International Application No. PCT/EP2008/050227, filed Jan. 10, 2008, which claims benefit of European Patent Application No. 07000602.8, filed Jan. 12, 2007, each of which is hereby incorporated by reference.

The invention relates to a composition comprising at least two protective proteins against *Streptococcus agalactiae* (*S. agalactiae*) or functionally active variants thereof; a protective peptide against *S. agalactiae*; one or more nucleic acid(s) encoding the at least two proteins and/or the protective peptide; a method of producing the composition; a pharmaceutical composition, especially a vaccine, comprising the composition and/or at least one protective peptide; methods for producing antibodies; a mixture of antibodies against the at least two proteins of the composition; the use of the composition and/or at least one protective peptide and/or one or more nucleic acid(s) for the manufacture of a medicament for the immunization or treatment of a subject; methods of diagnosing a *S. agalactiae* infection; a method for identifying a ligand capable of binding the composition and/or at least one protective peptide; and the use of the composition and/or at least one protective peptide for the isolation and/or purification and/or identification of an interaction partner of the composition and/or peptide.

*S. agalactiae* is an encapsulated gram-positive bacterium, which belongs to the Group B Streptococci (GBS) based on its haemolysis pattern on blood agar. Capsules form the basis for classifying GBS into nine distinct serotypes. Most of them have been shown to cause serious diseases, and the two most common serotypes—type III and V—are estimated to account for the majority (~80%) of invasive diseases worldwide. The ranking and serotype prevalence differs by age group and geographic area.

*Streptococcus agalactiae* is a frequent cause of infections in neonates, pregnant women and in chronically ill and elderly patients. In newborns Group B *Streptococcus* even represents the predominant pathogen in the United States causing life threatening diseases, such as sepsis, pneumonia and meningitis. GBS diseases are associated with a high mortality rate (~5%) and a large percentage (~20%) of children surviving GBS infections becomes permanently handicapped with hearing, learning and visual disabilities.

Newborns usually acquire the pathogen during delivery from their GBS-colonized mothers. Twenty-five to 40% of pregnant women are colonized with GBS, but are asymptomatic. Due to vertical transmission during birth, 50-70% of neonates born to colonized women—that is approximately 10-25% of all newborns—become colonized by GBS during delivery which is a prerequisite for infection and disease. In the United States, GBS infections affect 1-5 newborns/1,000 live births. Pre-term infants are at the highest risk for invasive disease due to their immature immune system and the low level of maternal antibody transfer before the $34^{th}$ pregnancy week.

GBS disease occurs throughout the world. The highest prevalence of invasive disease in newborns occurs in Western countries, due to the elimination and reduction of other infectious agents and also due to the increased survival of very immature newborns. Before prevention by intrapartum antibiotic treatment was introduced, about 17,000 cases of invasive GBS diseases (sepsis, pneumonia and/or meningitis) were reported in the US annually. The rates of serious GBS infections are higher among newborns than among any other age group. Nonetheless, serious Group B streptococcal infections occur in other age groups in both men and women. Among non-pregnant adults, rates of serious disease range from 4.1 to 7.2 cases per 100,000 and increase with age. The average death rate for invasive infections is 8-10% for adults between ages 18-64 and 15-25% for adults >65 years of age. Serious disease is most common among elderly, bedridden patients and people suffering from severe medical conditions including diabetes mellitus, liver disease, history of stroke, history of cancer or bedsores.

Currently, disease management fully relies on antibiotics, mainly Penicillin G. In order to prevent invasive disease in newborns, pregnant women are screened for carriage of GBS at $35^{th}$ to $37^{th}$ weeks of gestation. Colonized mothers are then treated with high dose antibiotics during delivery to prevent neonatal GBS disease.

Current standard treatment of GBS infections is also based on antibiotics. Route, dosage, schedule and duration of therapy depend on the severity of the illness. Ten days of treatment is recommended for bacteraemia, pneumonia and soft tissue infections, while 2-3 weeks is recommended for meningitis and 3-4 weeks for osteomyelitis.

Invasive GBS diseases are associated with 5% mortality and 20% permanent damage in spite of effective antibiotic therapy, due to a very rapid and dramatic clinical course. Before prevention direct medical costs of neonatal disease were ~$300 million annually in the US; and GBS still poses a considerable economic burden.

Although intrapartum prophylaxis has decreased the incidence of early-onset GBS disease, currently available strategies are not ideal as they can neither prevent late-onset infections nor disease in premature babies which are at highest risk for invasive disease.

Currently, no effective preventive vaccine is available. There are efforts focusing on using capsular polysaccharides (with or without protein-conjugation) as immunogens, but several arguments militate against that approach. Polysaccharides induce IgG2 antibodies, which cross the placenta less efficiently than IgG1 or IgG3 antibodies. This especially poses a problem for the most susceptible early-born neonates, since placental antibody transfer is low before the $34^{th}$ pregnancy week and about 10% of deliveries occur before that time. An additional disadvantage of polysaccharide vaccines is the incomplete vaccine coverage among GBS serotypes. Given adequate ecological pressure, replacement disease by non-vaccine serotypes remains a real threat, particularly in areas with high disease burden.

Taking these insufficiencies into account, new generation immune interventions against GBS disease are needed. Given the very recent acceptance of the use of a cervical cancer-preventing vaccine in teenage girls, a new approach would be the use of combinations of proteins as a prophylactic GBS vaccine in order to provide protection against more than one *S. agalactiae* strain or serotype.

Accordingly, one problem underlying the present invention was to provide alternative means for the development of medicaments such as vaccines against *S. agalactiae* infection. More particularly, one problem was to provide combinations of protective proteins, particularly more effective combinations, derived from *S. agalactiae* that can be used for the manufacture of said medicaments.

Surprisingly, this object has been solved by combinations of protective proteins/peptides comprising or consisting of the amino acid sequences as defined in SEQ ID NOS: 1 to 6 or functionally active variants thereof.

Accordingly, a first subject of the present invention relates to a composition comprising at least two proteins selected from the group consisting of
  i) a protective protein comprising or consisting of the protective peptide of SEQ ID NO: 1 (gbs0233p) or functionally active variant thereof;
  ii) a protective protein comprising or consisting of the protective peptide of SEQ ID NO: 2 (gbs1087p) or functionally active variant thereof;
  iii) a protective protein comprising or consisting of the protective peptide of SEQ ID NO: 3 (gbs1309p) or functionally active variant thereof;
  iv) a protective protein comprising or consisting of the protective peptide of SEQ ID NO: 4 (gbs1477p) or functionally active variant thereof;
  v) a protective protein comprising or consisting of the protective peptide of SEQ ID NO: 5 (gbs1478p) or functionally active variant thereof; and
  vi) a protective protein comprising or consisting of the protective peptide of SEQ ID NO: 6 (gbs2018p) or functionally active variant thereof.

Surprisingly, it was found that combinations of the above protective proteins provide a better protection against *S. agalactiae* than a protective protein when used alone. A better protection in the context of the present invention may refer to a situation in which protection provided by the combination is improved quantitatively in comparison to the single components of the composition. For example, the combination may provide protection against at least one serotype of *S. agalactiae* against which at least one of the protective proteins present in the composition does not provide protection. Accordingly, the number of serotypes against which the combination provides protection is increased. Additionally or alternatively, protection provided by the combination is improved qualitatively in comparison to the single components of the composition. For example, the survival of mice challenged with GBS strains may be improved when a composition of protective proteins is used in comparison to the single components of the composition. Both, quantitatively and qualitatively sufficient protection, are important for successful prevention and/or treatment, since it is the goal striven for to provide protection which is as high as possible and which protects against as many serotypes as possible.

Additionally, combinations of different protective proteins are in general advantageous in comparison to single protective proteins, since in the case of vaccines employing different protective proteins/antibodies the probability of a serotype switch of the pathogen in question leading to reduced effectiveness of the vaccine is strongly diminished. This is due to the fact that more than one mutation in *S. agalactiae* proteins at defined sites would be required in order to render the respective *S. agalactiae* strain unsusceptible to the vaccine.

The protective protein consisting of the amino acid sequence of SEQ ID NO: 1 is derived from *S. agalactiae* strain 12403 and has been denoted by gbs0233p (partial gbs0233) in accordance with the genome of NEM316 (ATCC12403). The DNA sequence encoding the full length protein gbs0233 (consisting of 308 amino acids; SEQ ID NO: 229) from which the protective protein consisting of the amino acid sequence of the SEQ ID NO: 1 is derived is disclosed at GenBank® accession number AL732656 (complete genome of *Streptococcus agalactiae* NEM316) and the amino acid sequence of the full length protein is disclosed in WO2004/099242 (see SEQ ID NO: 475). The amino acid sequence of SEQ ID NO: 1 is disclosed in the Examples as well as in the attached Sequence listing. The protective protein comprising or consisting of the protective peptide of SEQ ID NO: 1 or a functionally active variant thereof are referred to as (protective) proteins of subgroup i).

The protective protein consisting of the amino acid sequence of SEQ ID NO: 2 is derived from *S. agalactiae* strain 6313 and has been denoted by gbs1087p (partial gbs1087) in accordance with the genome of NEM316 (ATCC12403). The amino acid and encoding DNA sequences of the full length protein gbs1087 (also referred to as FbsA and consisting of 442 amino acids; SEQ ID NO: 230) from which the protective protein consisting of the amino acid sequence of the SEQ ID NO: 2 is derived is disclosed in WO2004/035618 (see FIG. 1 and SEQ ID NO: 11). The amino acid sequence of SEQ ID NO: 2 is disclosed in the Examples as well as in the attached Sequence listing. The protective protein comprising or consisting of the protective peptide of SEQ ID NO: 2 or a functionally active variant thereof are referred to as (protective) proteins of subgroup ii).

The protective protein consisting of the amino acid sequence of SEQ ID NO: 3 is derived from *S. agalactiae* strain 12403 and has been denoted by gbs1309p (partial gbs1309) in accordance with the genome of NEM316 (ATCC 12403). The DNA sequence encoding the full length protein gbs1309 (consisting of 403 amino acids; SEQ ID NO: 231) from which the protective protein consisting of the amino acid sequence of the SEQ ID NO: 3 is derived is disclosed in GenBank® accession number AL732656 (complete genome of *Streptococcus agalactiae* NEM316) and the amino acid sequence of the full length protein is disclosed in WO2004/099242 (see SEQ ID NO: 307). The amino acid sequence of SEQ ID NO: 3 is disclosed in the Examples as well as in the attached Sequence listing. The protective protein comprising or consisting of the protective peptide of SEQ ID NO: 3 or a functionally active variant thereof are referred to as (protective) proteins of subgroup iii).

The protective protein consisting of the amino acid sequence of SEQ ID NO: 4 is derived from *S. agalactiae* strain 6313 and has been denoted by gbs1477p (partial gbs1477) in accordance with the genome of NEM316 (ATCC12403). The amino acid and encoding DNA sequences of the full length protein gbs1477 (also referred to as PabB and consisting of 674 amino acids; SEQ ID NO: 232) from which the protective protein consisting of the amino acid sequence of the SEQ ID NO: 4 is derived is disclosed in WO2004/035618 (see FIG. 16 and SEQ ID NO: 18). The amino acid sequence of SEQ ID NO: 4 is disclosed in the Examples as well as in the attached Sequence listing. The protective protein comprising or consisting of the protective peptide of SEQ ID NO: 4 or a functionally active variant thereof are referred to as (protective) proteins of subgroup iv).

The protective protein consisting of the amino acid sequence of SEQ ID NO: 5 is derived from *S. agalactiae* strain 6313 and has been denoted by gbs1478p (partial gbs1478) in accordance with the genome of NEM316 (ATCC 12403). The amino acid and encoding DNA sequences of the full length protein gbs1478 (also referred to as PabA and consisting of 901 amino acids; SEQ ID NO: 233) from which the protective protein consisting of the amino acid sequence of the SEQ ID NO: 5 is derived is disclosed in WO2004/035618 (see FIG. 16 and SEQ ID NO: 17). The amino acid sequence of SEQ ID NO: 5 is disclosed in the Examples as well as in the attached Sequence listing. The protective protein comprising or consisting of the protective peptide of SEQ ID NO: 5 or a functionally active variant thereof are referred to as (protective) proteins of subgroup v).

The protective protein consisting of the amino acid sequence of SEQ ID NO: 6 is derived from *S. agalactiae* strain 12403 and has been denoted by gbs2018p (partial gbs2018) in accordance with the genome of NEM316 (ATCC12403). The DNA sequence encoding the full length protein gbs2018 (also referred to as BibA (Santi et al., 2007, Mol. Microbiol. 63:754-767) and consisting of 643 amino acids; SEQ ID NO: 234) from which the protective protein consisting of the amino acid sequence of the SEQ ID NO: 6 is derived is disclosed at GenBank® accession number AL732656 (complete genome of *Streptococcus agalactiae* NEM316) and the amino acid sequence of the full length protein is disclosed in WO2004/099242 (see SEQ ID NO: 364). The amino acid sequence of SEQ ID NO: 6 is disclosed in the Examples as well as in the attached Sequence listing. The protective protein comprising or consisting of the protective peptide of SEQ ID NO: 6 or a functionally active variant thereof are referred to as (protective) proteins of subgroup vi).

The combinations of the protective proteins of the sequences of SEQ ID NO: 1 to 6 have been shown to induce a protective immune response against different serotypes and/or to show increased protection against *S. agalactiae* in an animal model (see Examples). Functionally active variants may be obtained by changing the sequence of at least one of the protective proteins of SEQ ID NO: 1 to 6 and are characterized by having a biological activity similar to that displayed by the respective protective protein of the sequence of SEQ ID NO: 1 to 6 from which the variant is derived, including the ability to induce protective immune responses and/or to show protection against *S. agalactiae* e.g. in an animal model, wherein any variant may be tested in any of the tests described in the Examples. The functionally active variant of a protective protein may be obtained by sequence alterations in the protective protein, wherein the protein with the sequence alterations essentially retains a function of the unaltered protective protein, e.g. having a biological activity similar to that displayed by the unaltered protective protein (see above) including the ability to induce protective immune responses and/or to show protection against *S. agalactiae*. Such sequence alterations can include, but are not limited to, (conservative) substitutions, deletions, mutations and insertions.

In a preferred embodiment of the invention the composition comprises at least three proteins selected from the group consisting of subgroup i) to vi). In an even more preferred embodiment of the invention the composition comprises at least four proteins selected from the group consisting of subgroup i) to vi).

In a preferred embodiment of the invention the at least two, three or four proteins of the composition of the invention are selected from different subgroups i) to vi). Alternatively or additionally, at least two of the proteins of the composition of the invention are selected from one of the subgroups i) to vi).

Examples of combinations of the first alternative (selection of protective proteins from different groups) are compositions comprising:
  one protein of subgroup i) and one protein of subgroup ii);
  one protein of subgroup i) and one protein of subgroup iii);
  one protein of subgroup i) and one protein of subgroup iv);
  one protein of subgroup i) and one protein of subgroup v);
  one protein of subgroup i) and one protein of subgroup vi);
  one protein of subgroup ii) and one protein of subgroup iii);
  one protein of subgroup ii) and one protein of subgroup iv);
  one protein of subgroup ii) and one protein of subgroup v);
  one protein of subgroup ii) and one protein of subgroup vi);
  one protein of subgroup iii) and one protein of subgroup iv);
  one protein of subgroup iii) and one protein of subgroup v);
  one protein of subgroup iii) and one protein of subgroup vi);
  one protein of subgroup iv) and one protein of subgroup v);
  one protein of subgroup iv) and one protein of subgroup vi);
  one protein of subgroup v) and one protein of subgroup vi);
  one protein of subgroup i) and one protein of subgroup ii) and one protein selected from any of the subgroups to vi);
  one protein of subgroup i) and one protein of subgroup iii) and one protein selected from any of the subgroups or iv) to vi);
  one protein of subgroup i) and one protein of subgroup iv) and one protein selected from any of the subgroups ii), iii), v) or vi);
  one protein of subgroup i) and one protein of subgroup v) and one protein selected from any of the subgroups to iv) or vi);
  one protein of subgroup i) and one protein of subgroup vi) and one protein selected from any of the subgroups ii) to v);
  one protein of subgroup ii) and one protein of subgroup iii) and one protein selected from any of the subgroups i) or iv) to vi);
  one protein of subgroup ii) and one protein of subgroup iv) and one protein selected from any of the subgroups i), iii), v) or vi);
  one protein of subgroup and one protein of subgroup v) and one protein selected from any of the subgroups i), iv) or vi);
  one protein of subgroup ii) and one protein of subgroup vi) and one protein selected from any of the subgroups i) or to v);
  one protein of subgroup iii) and one protein of subgroup iv) and one protein selected from any of the subgroups i), ii), v) or vi);
  one protein of subgroup iii) and one protein of subgroup v) and one protein selected from any of the subgroups i), ii), iv) or vi);
  one protein of subgroup and one protein of subgroup vi) and one protein selected from any of the subgroups i), ii), iv) or v);
  one protein of subgroup iv) and one protein of subgroup v) and one protein selected from any of the subgroups i) to iii) or vi);
  one protein of subgroup iv) and one protein of subgroup vi) and one protein selected from any of the subgroups i) to iii) or v); or
  one protein of subgroup v) and one protein of subgroup vi) and one protein selected from any of the subgroups i) to iv).

Preferred examples are:
one protein of subgroup iv) and one protein of subgroup vi);
one protein of subgroup iv), one protein of subgroup vi) and one protein of subgroup ii);
one protein of subgroup iv), one protein of subgroup vi), one protein of subgroup ii) and one protein of subgroup v);
one protein of subgroup iv), one protein of subgroup vi), one protein of subgroup ii) one protein of subgroup v) and one protein of subgroup i);

one protein of subgroup iv), one protein of subgroup vi), one protein of subgroup ii), one protein of subgroup v) and one protein of subgroup iii); or one protein of subgroup iv), one protein of subgroup vi), one protein of subgroup ii), one protein of subgroup v), one protein of subgroup i) and one protein of subgroup iii).

In an alternative preferred embodiment of the invention at least two of the proteins of the composition of the invention may be selected from one of the subgroups i) to vi). The at least two proteins may be selected in order to cover different strains or serotypes of *S. agalactiae* and, accordingly, to provide protection against e.g. different strains or serotypes of *S. agalactiae*. The complete genome of *Streptococcus agalactiae* NEM316 (strain 12403) is available at GenBank® accession number AL732656. Furthermore, the complete or incomplete genomic sequences of the following strains of *Streptococcus agalactiae* are available at GenBank® (NIH genetic sequence database; http://www.ncbi.nlmnih.gov/) or NCBI (National Center for Biotechnology Information, Bethesda, Md., USA; http://www.ncbi.nlm.nih.gov/) using the indicated accession numbers:

| Strain | Serotype | Source |
|---|---|---|
| 515 | Ia | NCBI: NZ_AAJP00000000 |
| | | GenBank ®: AAJP00000000 |
| A909 | Ia/c | NCBI: NC_007432 |
| | | GenBank ®: CP000114 |
| H36B | Ib | NCBI: NZ_AAJS00000000 |
| | | GenBank ®: AAJS00000000 |
| 18RS21 | II | NCBI NZ_AAJO00000000 |
| | | GenBank ®: AAJO00000000 |
| COH1 | III | NCBI: NZ_AAJR00000000 |
| | | GenBank ®: AAJR00000000 |
| ATCC12403 (NEM316) | III | NCBI: NC_004368 |
| | | GenBank ®: AL732656 |
| 2603V/R | V | NCBI: NC_004116 |
| | | GenBank ®: AE009948 |
| CJB111 | V | NCBI: NZ_AAJQ00000000 |
| | | GenBank ®: AAJQ00000000 |

Using the sequences of SEQ ID NO: 1 to 6 as specified in the present description and knowing the sequences of other *S. agalactiae* strains (e.g. vide supra) the skilled person is able to identify the corresponding sequences of *S. agalactiae* strains other than 12403 (for SEQ ID NO: 1, 3 and 6) or 6313 (for SEQ ID NO: 2, 4 and 5) without undue burden. The corresponding sequences may be identified using e.g. the tools and sequences provided by "The Comprehensive Microbial Resource (CMR)" (see http://cmr.tigr.org/). However, it should be understood that the above strains are listed as examples of different *S. agalactiae* strains and that the present invention is not to be limited to those strains.

Additionally, examples of sequences of the proteins corresponding to SEQ ID NO: 1 to 6 and derived from other serotypes are published or disclosed in:

| Protein or Analogue | NCBI Accession Number (strain [serotype]) or SEQ ID NO |
|---|---|
| gbs0233 | Any sequence of SEQ ID NO: 55 to 60 (see Table 7), 229 and 235 to 286. |
| gbs1087 | CAD12883 (6313); CAD27183 (706 82 [Ia]); CAD27181 (SS1169 [V]); CAD27186 (O90R); CAD27182 (O176 H4A [II]) or any sequence of SEQ ID NO: 67 to 72 (see Table 8), 230 and 287 to 316. |
| gbs1309 | Any sequence of SEQ ID NO: 79 to 84 (see Table 9), 231 and 317 to 359. |
| gbs1477 | Any sequence of SEQ ID NO: 91 to 132 (see Table 10), 223 to 228 (see FIG. 5), 232 and 360 to 362. |
| gbs1478 | Any sequence of SEQ ID NO: 185 to 203 (see Table 11), 233 and 363 to 378. |
| gbs2018 | CAJ66802 (CCH57); CAJ66794 (CCH180); CAJ66788 (NEM1002); CAJ 66790 (NEM1560) or any sequence of SEQ ID NO: 175 to 179 (see Table 12), 234 and 379 to 425. |

However, it should be understood that the present invention is not limited to the variants and corresponding proteins described above. Other naturally occurring proteins corresponding to those of SEQ ID NO: 1 to 6 may be identified as described above and used in order to carry out the present invention.

Examples of combinations of the second alternative (selection of protective proteins from one group only) are compositions comprising:

at least two different proteins of subgroup i), preferably selected from the group consisting of proteins comprising or consisting of SEQ ID NO: 1 or a naturally occurring variant thereof;

at least two different proteins of subgroup ii), preferably selected from the group consisting of proteins comprising or consisting of SEQ ID NO: 2 or a naturally occurring variant thereof;

at least two different proteins of subgroup iii), preferably selected from the group consisting of proteins comprising or consisting of SEQ ID NO: 3 or a naturally occurring variant thereof;

at least two different proteins of subgroup iv), preferably selected from the group consisting of proteins comprising or consisting of SEQ ID NO: 4 or a naturally occurring variant thereof, at least two different proteins of subgroup v), preferably selected from the group consisting of proteins comprising or consisting of SEQ ID NO: 5 or a naturally occurring variant thereof;

at least two different proteins of subgroup vi), preferably selected from the group consisting of proteins comprising or consisting of SEQ ID NO: 6 or a naturally occurring variant thereof;

preferably at least two protective proteins each comprising or consisting of a sequence selected from SEQ ID NO: 55 to 60 (see Table 7), 235 to 286, and optionally 229;

preferably at least two protective proteins each comprising or consisting of a sequence selected from SEQ ID NO: 67 to 72 (see Table 8), 287 to 316, and optionally 230;

preferably at least two protective proteins each comprising or consisting of a sequence selected from SEQ ID NO: 79 to 84 (see Table 9), 317 to 359, and optionally 231;

preferably at least two protective proteins each comprising or consisting of a sequence selected from SEQ ID NO: 185 to 203 (see Table 11), 363 to 378, and optionally 233;

preferably at least two protective proteins each comprising or consisting of a sequence selected from SEQ ID NO: 175 to 179 (see Table 12), 379 to 425 and optionally 234; or more preferably at least two protective proteins each comprising or consisting of a sequence selected from SEQ ID NO: 91 to 132 (sec Table 10), 360 to 362, or 223 to 228 (see FIG. 5) and optionally 232.

In a preferred embodiment the naturally occurring variants are those derived from *S. agalactiae* strains selected from the group consisting of IC97, IC98, IC105, IC108, IC216, IC244, IC245, IC246, IC247, IC250, IC251, IC252, IC253, IC254, IC255, IC287, IC288, IC289, IC290, IC291, IC304, IC305, IC306, IC361, IC363, IC364, IC365, IC366, IC367, IC368, IC377, IC379, IC432, IC434, IC455, IC457, IC458, IC459, IC460, IC461, IC462, IC463, IC469, IC470, 126H4A, 5095S2, 6313, 12351, 12403 (NEM316), 12401, COH1, BAA23, 0176H4A, A909, C388/90, BAA22, 2603V/R, 49447, BAA611, 515, H36B, 18RS21, CJB111, and those disclosed in Tables 7 to 13.

In another preferred embodiment of the present invention the composition of the invention comprises
  at least one protein of subgroup iv);
  at least one protein of subgroup vi);
  at least one protein of subgroup iv) and at least one protein of subgroup vi);
  at least one protein of subgroup iv), at least one protein of subgroup vi) and at least one protein of subgroup ii); or
  at least one protein of subgroup iv), at least one protein of subgroup vi), at least one protein of subgroup ii) and at least one protein of subgroup v).

In a preferred embodiment of the invention one of the at least two proteins comprises or consists of the protective peptide of SEQ ID NO: 4 (gbs1477p) or a functionally active variant thereof, preferably protective peptide of SEQ ID NO: 4 (gbs1477p) or a naturally occurring functionally active variant thereof, more preferably a naturally occurring functionally active variant as listed in Tables 10, 13, and in the Sequence listing.

In another preferred embodiment of the invention one of the at least two proteins comprises or consists of the protective peptide of SEQ ID NO: 6 (gbs2018p) or a functionally active variant thereof, preferably protective peptide of SEQ ID NO: 6 (gbs2018p) or a naturally occurring functionally active variant thereof, more preferably a naturally occurring functionally active variant as listed in Tables 12, 13, and in the Sequence listing.

In another preferred embodiment of the invention one of the at least two proteins comprises or consists of the protective peptide of SEQ ID NO: 2 (gbs1087p) or a functionally active variant thereof, preferably protective peptide of SEQ ID NO: 2 (gbs1087p) or a naturally occurring functionally active variant thereof, more preferably a naturally occurring functionally active variant as listed in Tables 8, 13, and in the Sequence listing.

In another preferred embodiment of the invention one of the at least two proteins comprises or consists of the protective peptide of SEQ ID NO: 5 (gbs1478p) or a functionally active variant thereof, preferably protective peptide of SEQ ID NO: 5 (gbs1478p) or a naturally occurring functionally active variant thereof, more preferably a naturally occurring functionally active variant as listed in Tables 11, 13, and in the Sequence listing.

In another preferred embodiment of the invention one of the at least two proteins comprises or consists of the protective peptide of SEQ ID NO: 1 (gbs0233p) or a functionally active variant thereof, preferably protective peptide of SEQ ID NO: 1 (gbs0233p) or a naturally occurring functionally active variant thereof, more preferably a naturally occurring functionally active variant as listed in Tables 7, 13, and in the Sequence listing.

In another preferred embodiment of the invention one of the at least two proteins comprises or consists of the protective peptide of SEQ ID NO: 3 (gbs1309p) or a functionally active variant thereof, preferably protective peptide of SEQ ID NO: 3 (gbs1309p) or a naturally occurring functionally active variant thereof, more preferably a naturally occurring functionally active variant as listed in Tables 9, 13, and in the Sequence listing.

In a more referred embodiment of the invention the at least two proteins of the composition of the invention encompass:
  the protective peptide of SEQ ID NO: 4 (gbs1477p) and the protective peptide of SEQ ID NO: 6 (gbs2018p);
  the protective peptide of SEQ ID NO: 4 (gbs1477p) and the protective peptide of SEQ ID NO: 6 (gbs2018p) and the protective peptide of SEQ ID NO: 2 (gbs1087p); or
  the protective peptide of SEQ ID NO: 4 (gbs1477p) and the protective peptide of SEQ ID NO: 6 (gbs2018p) and the protective peptide of SEQ ID NO: 2 (gbs1087p) and the protective peptide of SEQ ID NO: 5 (gbs1478p).

In a further preferred embodiment of the invention a naturally occurring functionally active variant of any of the protective peptides of SEQ ID NO: 1 to 6 of the above list of compositions may be used. Examples of the resulting combinations are:
  I. the protective peptide of SEQ ID NO: 4 (gbs1477p) and a naturally occurring functionally active variant of SEQ ID NO: 6 (gbs2018p);
  II. a naturally occurring functionally active variant of SEQ ID NO: 4 (gbs1477p) and the protective peptide of SEQ ID NO: 6 (gbs2018p);
  III. a naturally occurring functionally active variant of SEQ ID NO: 4 (gbs1477p) and a naturally occurring functionally active variant of SEQ ID NO: 6 (gbs2018p);
  IV. the protective peptide of SEQ ID NO: 4 (gbs1477p) and the protective peptide of SEQ ID NO: 6 (gbs2018p) and a naturally occurring functionally active variant of SEQ ID NO: 2 (gbs1087p);
  V. the protective peptide of SEQ ID NO: 4 (gbs1477p) and a naturally occurring functionally active variant of SEQ ID NO: 6 (gbs2018p) and the protective peptide of SEQ ID NO: 2 (gbs1087p);
  VI. a naturally occurring functionally active variant of SEQ ID NO: 4 (gbs1477p) and the protective peptide of SEQ ID NO: 6 (gbs2018p) and the protective peptide of SEQ ID NO: 2 (gbs1087p);
  VII. a naturally occurring functionally active variant of SEQ ID NO: 4 (gbs1477p) and a naturally occurring functionally active variant of SEQ ID NO: 6 (gbs2018p) and the protective peptide of SEQ ID NO: 2 (gbs1087p);
  VIII. the protective peptide of SEQ ID NO: 4 (gbs1477p) and a naturally occurring functionally active variant of SEQ ID NO: 6 (gbs2018p) and a naturally occurring functionally active variant of SEQ ID NO: 2 (gbs1087p);
  IX. a naturally occurring functionally active variant of SEQ ID NO: 4 (gbs1477p) and the protective peptide of SEQ ID NO: 6 (gbs2018p) and a naturally occurring functionally active variant of SEQ ID NO: 2 (gbs1087p);
  X. a naturally occurring functionally active variant of SEQ ID NO: 4 (gbs1477p) and a naturally occurring functionally active variant of SEQ ID NO: 6 (gbs2018p) and a naturally occurring functionally active variant of SEQ ID NO: 2 (gbs1087p);
  XI. any of the compositions of I to X in combination with the protective peptide of SEQ ID NO: 5 (gbs1478p); or
  XII. any of the compositions of I to X in combination with a naturally occurring functionally active variant of SEQ ID NO: 5 (gbs1478p).

wherein the naturally occurring functionally active variant is selected form those listed in Tables 7 to 13 and FIG. 5 and those of SEQ ID NO: 229 to 234 and 235 to 425.

Preferred *S. agalactiae* strains from which the naturally occurring functionally active variant may be derived include IC97, IC98, IC105, IC108, IC216, IC244, IC245, IC246, IC247, IC250, IC251, IC252, IC253, IC254, IC255, IC287, IC288, IC289, IC290, IC291, IC304, IC305, IC306, IC361, IC363, IC364, IC365, IC366, IC367, IC368, IC377, IC379, IC432, IC434, IC455, IC457, IC458, IC459, IC460, IC461, IC462, IC463, IC469, IC470, 126H4A, 5095S2, 6313, 12351, 12403 (NEM316), 12401, COH1, BAA23, 0176H4A, A909, C388/90, BAA22, 2603V/R, 49447, BAA611, 515, H36B, 18RS21, CJB111, and those disclosed in Tables 7 to 13.

In one embodiment of the invention two or more proteins of the at least two proteins of the composition of the invention may be combined into at least one fusion protein. The resulting fusion protein may encompass two or more of the proteins of subgroups i), ii), iii), iv), v) and/or vi) as defined above. Any of the specific combinations mentioned above may be combined into at least one fusion protein. The fusion protein may encompass e.g. the same protein components as described in the section "examples of combinations of the first alternative (selection of protective proteins from different groups)" for the components of the composition, wherein the proteins can be arranged in the fusion protein in any suitable manner.

The fusion protein may comprise or consist of two or more proteins as defined above. Additionally, the fusion protein may encompass a linker, such as a protein linker, to connect the two or more proteins or additional C- or N-terminal sequences, such as a tag in order to purify the fusion protein. Additional sequences may also result from genetic engineering and the use of suitable restriction sites when preparing the nucleic acid sequences underlying the fusion protein.

The proteins of subgroup i), ii), iii), iv), v) and/or vi) combined in a fusion protein may be directly joined to each other or may be combined over a linker. The linker may be e.g. a short amino acid sequence. The linker may result from the genetic engineering of a suitable fusion protein or may be introduced in order to allow the single proteins to operate effectively.

In a preferred embodiment the functionally active variant a) is a functionally active fragment of the protective peptide, the functionally active fragment comprising at least 50% of the sequence of the protective peptide, preferably at least 70%, more preferably at least 80%, still more preferably at least 90%, even more preferably at least 95% and most preferably at least 97%, 98% or 99%;

b) is derived from the protective peptide by at least one amino acid substitution, addition and/or deletion, wherein the functionally active variant has a sequence identity to the protective peptide or to the functionally active fragment as defined in a) of at least 40%, preferably at least 60%, more preferably at least 75%, still more preferably at least 90%, even more preferably at least 95% and most preferably at least 97%, 98% or 99%; and/or c) consists of the protective peptide or a functionally active variant thereof and additionally at least one amino acid heterologous to the protective peptide, preferably wherein the functionally active variant is derived from or identical to any of the naturally occurring variants of any of the sequences of SEQ ID NO: 55 to 60, 67 to 72, 79 to 84, 91 to 132, 175 to 179, 185 to 203, 223 to 234, and 235 to 425.

The combinations of protective peptides of SEQ ID NO: 1 to 6 have been shown to induce a protective immune response against different serotypes and/or to show protection against *S. agalactiae* in a sepsis model (see Examples). Functionally active variants may be obtained by changing the sequence of the protective peptide as defined above and are characterized by having a biological activity similar to that displayed by the respective protective peptide of the sequence of SEQ ID NO: 1 to 6 from which the variant is derived, including the ability to induce protective immune responses and/or to show protection against *S. agalactiae* e.g. in a sepsis model, wherein any variant may be tested in any of the tests described in the Examples within a composition of at least two proteins as defined above. The functionally active variant of a protective peptide may be obtained by sequence alterations in the protective peptide, wherein the peptide with the sequence alterations retains a function of the unaltered protective peptide, e.g. having a biological activity similar to that displayed by the unaltered protective peptide (see above), when used in combination of the invention. Such sequence alterations can include, but are not limited to, (conservative) substitutions, additions, deletions, mutations and insertions.

The variant of the protective peptide is functionally active in the context of the present invention, if the activity of the composition of the invention including the variant (but not the original protein) amounts to at least 10%, preferably at least 25%, more preferably at least 50%, even more preferably at least 70%, still more preferably at least 80%, especially at least 90%, particularly at least 95%, most preferably at least 99% of the activity of the composition of the invention including the protective peptide without sequence alteration (i.e. the original protein). The activity of the composition including the variant may be determined or measured as described in the Examples and then compared to that obtained for the composition including the respective protective peptide of the amino acid sequence of SEQ ID NO: 1 to 6 instead of the variant.

The functionally active fragment of the protective peptide is characterized by being derived from the protective peptide of SEQ ID NO: 1 to 6 by one or more deletions resulting in a peptide comprising at least 50% of the sequence of the protective peptide, preferably at least 70%, more preferably at least 80%, still more preferably at least 90%, even more preferably at least 95% and most preferably at least 97%, 98% or 99%. Sequence identity may be determined as described below. The deletion(s) may be C-terminally, N-terminally and/or internally. Preferably the fragment is obtained by 1, 2, 3, 4, 5, 6, 7, 8, 9 or 10, more preferably 1, 2, 3, 4 or 5, even more preferably 1, 2 or 3, still more preferably 1 or 2, most preferably 1 deletion(s).

Alternatively or additionally, the variant may be obtained from the protective peptide by at least one amino acid substitution, addition and/or deletion, wherein the functionally active variant has a sequence identity to the protective peptide or to the functionally active fragment as defined in a) of at least 40%, preferably at least 60%, more preferably at least 75%, still more preferably at least 90%, even more preferably at least 95% and most preferably at least 97%, 98% or 99%. Sequence identity may be determined as described below. The substitution(s), addition(s) and/or deletion(s) may be C-terminally, N-terminally and/or internally. Preferably, the functionally active variant is obtained from the protective peptide or the fragment, preferably the protective peptide, by 1, 2, 3, 4, 5, 6, 7, 8, 9 or 10, more preferably 1, 2, 3, 4 or 5, even more preferably 1, 2 or 3, still more preferably 1 or 2, most preferably 1 amino acid substitution(s), addition(s) and/or deletion(s).

Furthermore, the variant may consist of the protective peptide or the functionally active variant thereof, preferably the variant of a) and/or b), and at least one amino acid residue heterologous to the protective peptide or variant thereof, such as a marker protein. The feature "heterologous amino acid" or "amino acid heterologous to the protective peptide or variant thereof" refers to any amino acid which is different from that amino acid located adjacent to the protective protein in any naturally occurring protein of *S. agalactiae*, particularly from that of strain 12403 (for SEQ ID NO: 1, 3 and 6) or 6313 (for SEQ ID NO: 2, 4 and 5), especially the sequence made reference to above. The one or more additional amino acids may be C-terminally, N-terminally or C- and N-terminally to the protective peptide or variant thereof.

The substituted or additional sequence or amino acid residue(s) as defined above consists of (an) amino acid residue(s), which may be any amino acid, which may be either an L- and/or a D-amino acid, naturally occurring and otherwise. Preferably the amino acid is any naturally occurring amino acid such as alanine, cysteine, aspartic acid, glutamic acid, phenylalanine, glycine, histidine, isoleucine, lysine, leucine, methionine, asparagine, proline, glutamine, arginine, serine, threonine, valine, tryptophan or tyrosine.

However, the amino acid may also be a modified or an unusual amino acid. Examples of those are 2-aminoadipic acid, 3-aminoadipic acid, beta-alanine, 2-aminobutyric acid, 4-aminobutyric acid, 6-aminocaproic acid, 2-aminoheptanoic acid, 2-aminoisobutyric acid, 3-aminoisobutyric acid, 2-aminopimelic acid, 2,4-diaminobutyric acid, desmosine, 2,2'-diaminopimelic acid, 2,3-diaminopropionic acid, N-ethylglycine, N-ethylasparagine, hydroxylysine, allo-hydroxylysine, 3-hydroxyproline, 4-hydroxyproline, isodesmosine, allo-isoleucine, N-methylglycine, N-methylisoleucine, 6-N-methyllysine, N-methylvaline, norvaline, norleucine or ornithine. Additionally, the amino acid may be subject to modifications such as posttranslational modifications. Examples of modifications include acetylation, amidation, blocking, formylation, gamma-carboxyglutamic acid hydroxylation, glycosylation, methylation, phosphorylation and sulfatation. If more than one substituted or additional heterologous amino acid residue is present in the peptide, the amino acid residues may be the same or different from one another.

In one preferred embodiment of the invention, the functionally active variant of the peptide of the invention is essentially identical to the protective peptide of subgroups i) to vi), but differs from the peptide of the SEQ ID NO: 1 to 6, respectively, in that it is derived from a homologous sequence of a different strain or even serotype of *S. agalactiae*. As detailed above different strains and serotypes of *S. agalactiae* have been identified so far. Accordingly, any of these serotypes may be the basis for the functionally active variant. These are referred to as naturally occurring variants (see also above). Preferably, these naturally occurring variants are derived from *S. agalactiae* strains selected from the group consisting of IC97, IC98, IC105, IC108, IC216, IC244, IC245, IC246, IC247, IC250, IC251, IC252, IC253, 1C254, IC255, IC287, IC288, IC289, IC290, IC291, IC304, IC305, IC306, IC361, IC363, IC364, IC365, IC366, IC367, IC368, IC377, IC379, IC432, IC434, IC455, IC457, IC458, IC459, IC460, IC461, IC462, IC463, IC469, IC470, 126H4A, 5095S2, 6313, 12351, 12403 (NEM316), 12401, COH1, BAA23, 0176H4A, A909, C388/90, BAA22, 2603V/R, 49447, BAA611, 515, H36B, 18RS21, CJB111, and those disclosed in Tables 7 to 13.

However, the term "functionally active variant" includes naturally occurring allelic variants, as well as mutants or any other non-naturally occurring variants. As is known in the art, an allelic variant is an alternate form of a (poly)peptide that is characterized as having a substitution, deletion, or addition of one or more amino acids that does essentially not alter the biological function of the polypeptide. By "biological function" is meant a function of the peptide in the cell it naturally occurs in, even if the function is not necessary for the growth or survival of the cells. For example, the biological function of a porin is to allow the entry into cells of compounds present in the extracellular medium. The biological function is distinct from the antigenic function. A polypeptide can have more than one biological function.

Accordingly, the present invention also relates to compositions comprising protective peptides including functionally active variants thereof of different *S. agalactiae* isolates. Such homologues may easily be identified and isolated based on the nucleic acid and amino acid sequences disclosed herein as discussed above. A homologous protective peptide of a different strain or even serotype may be identified by e.g. sequence alignment. The homologous sequence may vary from any of the protective peptides of subgroups i) to vi), by one or more amino acid substitutions, deletions and/or additions.

Percentage of sequence identity can be determined e.g. by sequence alignment. Methods of alignment of sequences for comparison are well known in the art. Various programs and alignment algorithms have been described e.g. in Smith and Waterman, Adv. Appl. Math. 2: 482, 1981 or Pearson and Lipman, Proc. Natl. Acad. Sci. U.S.A. 85: 2444-2448, 1988.

The NCBI Basic Local Alignment Search Tool (NCBI BLAST) (Altschul et al., J. Mol. Biol. 215: 403-410, 1990) is available from several sources, including the National Center for Biotechnology Information (NCBI, Bethesda, Md.) and on the Internet, for use in connection with the sequence analysis programs blastp, blastn, blastx, tblastn and tblastx. Variants, e.g. of any protective peptide of the sequences of SEQ ID NO: 1 to 6, are typically characterized using the NCBI Blast 2.0, gapped blastp set to default parameters. For comparisons of amino acid sequences of e.g. at least 85 amino acids, the "Blast 2 sequences" function may be employed using the default BLOSUM62 matrix set to default parameters, (gap existence cost of 11, and a per residue gap cost of 1).

In a preferred embodiment, the functionally active variant derived from the peptide as defined above by amino acid exchanges, deletions or insertions may also conserve, or more preferably improve, the activity (as defined above). Furthermore, these peptides may also cover epitopes, which trigger the same or preferably an improved T cell response. These epitopes are referred to as "heteroclitic". They have a similar or preferably greater affinity to MHC/HLA molecules, and the ability to stimulate the T cell receptors (TCR) directed to the original epitope in a similar or preferably stronger manner. Heteroclitic epitopes can be obtained by rational design i.e. taking into account the contribution of individual residues to binding to MHC/HLA as for instance described by (Rammensee, H. et al., 1999, Immunogenetics. 50: 213-219), combined with a systematic exchange of residues potentially interacting with the TCR and testing the resulting sequences with T cells directed against the original epitope. Such a design is possible for a skilled man in the art without much experimentation.

Conservative substitutions are those that take place within a family of amino acids that are related in their side chains and chemical properties. Examples of such families are amino acids with basic side chains, with acidic side chains, with non-polar aliphatic side chains, with non-polar aromatic side chains, with uncharged polar side chains, with small side chains, with large side chains etc. In one embodiment, one conservative substitution is included in the peptide. In another embodiment, two conservative substitutions or less are included in the peptide. In a further embodiment, three conservative substitutions or less are included in the peptide.

Examples of conservative amino acid substitutions include, but are not limited to, those listed below:

| Original Residue | Conservative Substitutions |
|---|---|
| Ala | Ser |
| Arg | Lys |
| Asn | Gln; His |
| Asp | Glu |
| Cys | Ser |
| Gln | Asn |
| Glu | Asp |
| His | Asn; Gln |
| Ile | Leu; Val |
| Leu | Ile; Val |
| Lys | Arg; Gln; Asn |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

In another embodiment of the invention the peptide as defined above may be modified by a variety of chemical techniques to produce derivatives having essentially the same activity (as defined above for fragments and variants) as the modified peptides, and optionally having other desirable properties. For example, carboxylic acid groups of the protein, whether C-terminal or side chain, may be provided in the form of a salt of a pharmaceutically-acceptable cation or esterified to form an ester, or converted to an amide. Amino groups of the peptide, whether amino-terminal or side chain, may be in the form of a pharmaceutically-acceptable acid addition salt, such as the HCl, HBr, acetic, benzoic, toluene sulfonic, maleic, tartaric and other organic salts, or may be converted to an amide. Hydroxyl groups of the peptide side chains may be converted to alkoxy or to an ester using well recognized techniques. Phenyl and phenolic rings of the peptide side chains may be substituted with one or more halogen atoms, such as fluorine, chlorine, bromine or iodine, or with alkyl, alkoxy, carboxylic acids and esters thereof, or amides of such carboxylic acids. Thiols can be protected with any one of a number of well recognized protecting groups, such as acetamide groups.

Peptides of this invention may be in combination with outer surface proteins or other proteins or antigens of other proteins. In such combination, the peptide may be in the form of a fusion protein. The peptides/proteins of the composition of the invention may be optionally fused to a selected peptide or protein derived from other microorganisms. For example, a peptide or protein may be fused at its N-terminus or C-terminus to a polypeptide from another pathogen or to more than one polypeptide in sequence. Peptides which may be useful for this purpose include polypeptides identified by the prior art.

In a preferred embodiment of the invention a protein/peptide of the composition of the invention is fused to an epitope tag which provides an epitope to which an anti-tag substance can selectively bind. The epitope tag is generally placed at the N- or C-terminus of the peptide but may be incorporated as an internal insertion or substitution as the biological activity permits. The presence of such epitope-tagged forms of a peptide can be detected using a substance such as an antibody against the tagged peptide. Also, provision of the epitope tag enables the peptide to be readily purified by affinity purification using an anti-tag antibody or another type of affinity matrix that binds to the epitope tag. Various tag polypeptides and their respective antibodies are well known in the art. Examples include a poly-histidine (poly-his) tag, e.g. a hexa-histidine tag as described in the Examples, a poly-histidine-glycine (poly-his-gly) tag, the HA tag polypeptide, the c-myc tag, the Strep tag and the FLAG tag.

Fusions also may include the peptides/proteins of the composition of this invention fused or coupled to moieties other than amino acids, including lipids and carbohydrates. Further, peptides/proteins/compositions of this invention may be employed in combination with other vaccinal agents described by the prior art, as well as with other types of vaccinal agents derived from other microorganisms. Such peptides/proteins are useful in the prevention, treatment and diagnosis of diseases caused by a wide spectrum of *Streptococcus* isolates.

These fusion proteins are constructed for use in the methods and compositions of this invention. These fusion proteins or multimeric proteins may be produced recombinantly, or may be synthesized chemically.

The peptides and proteins described herein may be prepared by any of a number of conventional techniques. Desired peptides may be chemically synthesized. An alternative approach involves generating the fragments of known peptides by enzymatic digestion, e.g., by treating the protein with an enzyme known to cleave proteins at sites defined by particular amino acid residues, or by digesting the DNA with suitable restriction enzymes, expressing the digested DNA and isolating the desired fragment. Yet another suitable technique involves isolating and amplifying a DNA fragment encoding a desired peptide fragment, by polymerase chain reaction (PCR). Oligonucicotides that define the desired termini of the DNA fragment are employed as the 5' and 3' primers in the PCR. Techniques for making mutations, such as deletions, insertions and substitutions, at predetermined sites in DNA, and therefore in proteins having a known sequence are well known. One of skill in the art using conventional techniques, such as PCR, may readily use the peptides, proteins and compositions provided herein to identify and isolate other similar proteins. Such methods are routine and not considered to require undue experimentation, given the information provided herein. For example, variations can be made using oligonucleotide-mediated site-directed mutagenesis (Carter et al., Nucl. Acids Res., 13:4431 (1985); Zoller et al., Nucl. Acids Res. 10:6487 (1987)), cassette mutagenesis (Wells et al., Gene, 34:315 (1985)), restriction selection mutagenesis (Wells et al., Philos. Trans. R. Soc. London SerA, 317:415 (1986)), PCR mutagenesis, or other known techniques can be performed on the cloned DNA to produce the peptide or composition of the invention.

Another subject of the invention relates to a protective peptide consisting of the amino acid sequence selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 55 to 57, 59, 60, 68, 69, 71, 72, 79 to 84, 91 to 132, 175 to 179, 185 to 203, 223 to 234, and 235 to 425 which have been shown to provide protection against *S. agalactiae* (see Examples).

Another subject of the invention relates to one or more nucleic acid(s) encoding the at least two proteins comprised in the composition according to the invention and/or any of the protective peptides according to the invention.

Nucleic acid molecules of the present invention may be in the form of RNA, such as mRNA or cRNA, or in the form of DNA, including, for instance, cDNA and genomic DNA e.g. obtained by cloning or produced by chemical synthetic techniques or by a combination thereof. The DNA may be triple-stranded, double-stranded or single-stranded. Single-stranded DNA may be the coding strand, also known as the sense strand, or it may be the non-coding strand, also referred to as the anti-sense strand. Nucleic acid molecule as used herein also refers to, among others, single- and double-stranded DNA, DNA that is a mixture of single- and double-stranded RNA, and RNA that is a mixture of single- and double-stranded regions, hybrid molecules comprising DNA and RNA that may be single-stranded or, more typically, double-stranded, or triple-stranded, or a mixture of single- and double-stranded regions. In addition, nucleic acid molecule as used herein refers to triple-stranded regions comprising RNA or DNA or both RNA and DNA.

The nucleic acid may be a fragment of a nucleic acid occurring naturally in S. agalactiae. The nucleic acid also includes sequences that are a result of the degeneration of the genetic code. There are 20 natural amino acids, most of which are specified by more than one codon. Therefore, all nucleotide sequences are included in the invention which result in the peptide as defined above.

Preferred examples of the nucleic acid(s) encoding the at least two proteins comprised in the composition according to the invention and/or any of the protective peptides according to the invention are those comprising or consisting of at least one nucleic acid sequence selected from the group consisting of SEQ ID NO: 7, SEQ ID NO: 8, SEQ ID NO: 9, SEQ ID NO: 10, SEQ ID NO: 11, SEQ ID NO: 12, SEQ ID NO: 61 to 66, SEQ ID NO: 73 to 78, SEQ ID NO: 85 to 90, SEQ ID NO: 133 to 174, SEQ ID NO: 180 to 184 and SEQ ID NO: 204 to 222. The above sequences are indicated in the Examples, Tables 7 to 12 and the attached Sequence listing.

Additionally, the nucleic acid may contain one or more modified bases. Such nucleic acids may also contain modifications e.g. in the ribose-phosphate backbone to increase stability and half life of such molecules in physiological environments. Thus, DNAs or RNAs with backbones modified for stability or for other reasons are "nucleic acid molecules" as that feature is intended herein. Moreover, DNAs or RNAs comprising unusual bases, such as inosine, or modified bases, such as tritylated bases, to name just two examples, are nucleic acid molecules within the context of the present invention. It will be appreciated that a great variety of modifications have been made to DNA and RNA that serve many useful purposes known to those of skill in the art. The term nucleic acid molecule as it is employed herein embraces such chemically, enzymatically or metabolically modified forms of nucleic acid molecule, as well as the chemical forms of DNA and RNA characteristic of viruses and cells, including simple and complex cells, inter alia. For example, nucleotide substitutions can be made which do not affect the peptide or protein or composition of the invention encoded by the nucleic acid, and thus any nucleic acid molecule which encodes an antigenic peptide or functionally active variant thereof or a composition of the invention as defined above is encompassed by the present invention.

Furthermore, any of the nucleic acid molecules encoding a peptide or composition of the invention can be functionally linked, using standard techniques such as standard cloning techniques, to any desired regulatory sequences, whether a S. agalactiae regulatory sequence or a heterologous regulatory sequence, heterologous leader sequence, heterologous marker sequence or a heterologous coding sequence to create a fusion protein.

The nucleic acid of the invention may be originally formed in vitro or in a cell in culture, in general, by the manipulation of nucleic acids by endonucleases and/or exonucleases and/or polymerases and/or ligases and/or recombinases or other methods known to the skilled practitioner to produce the nucleic acids.

In one embodiment of the invention, the nucleic acid(s) according to the invention is/are located in a vector or a cell other than S. agalactiae.

A vector may further include nucleic acid sequences that permit it to replicate in the host cell, such as an origin of replication, one or more therapeutic genes and/or selectable marker genes and other genetic elements known in the art such as regulatory elements directing transcription, translation and/or secretion of the encoded peptide or protein. The vector may be used to transduce, transform or infect a cell, thereby causing the cell to express nucleic acids and/or proteins other than those native to the cell. The vector optionally includes materials to aid in achieving entry of the nucleic acid into the cell, such as a viral particle, liposome, protein coating or the like. Numerous types of appropriate expression vectors for protein expression are known in the art, which may be used in standard molecular biology techniques. Such vectors are selected from among conventional vector types including insects, e.g., baculovirus expression, or yeast, fungal, bacterial or viral expression systems. Other appropriate expression vectors, of which numerous types are known in the art, can also be used for this purpose. Methods for obtaining such expression vectors are well-known (see, e.g. Sambrook et al., Molecular Cloning. A Laboratory Manual, 2nd edition, Cold Spring Harbor Laboratory, New York (1989)). In one embodiment, the vector is a viral vector. Viral vectors include, but are not limited to, retroviral and adenoviral vectors.

Suitable host cells or cell lines for transfection by this method include bacterial cells. For example, the various strains of E. coli are well-known as host cells in the field of biotechnology. Various strains of B. subtilis, Pseudomonas, Streptomyces, and other bacilli and the like may also be employed in this method. Many strains of yeast cells known to those skilled in the art are also available as host cells for expression of the peptides of the present invention. Other fungal cells or insect cells such as Spodoptera frugipedera (Sf9) cells may also be employed as expression systems. Alternatively, mammalian cells, such as human 293 cells, Chinese hamster ovary cells (CHO), the monkey COS-1 cell line or murine 3T3 cells derived from Swiss, BALB/c or NIH mice may be used. Still other suitable host cells, as well as methods for transfection, culture, amplification, screening, production, and purification are known in the art.

A further subject of the invention relates to a method of producing the composition according to the invention or the protective peptide according to the invention, comprising
  (a) introducing the one or more nucleic acids into a host cell;
  (b) expressing the protein(s) and/or peptide(s) encoded by the nucleic acid by culturing the host cell under conditions conducive to the expression of the protein(s) and/or peptide(s); and
  (c) collecting and/or isolating the expressed protein(s) and/ or peptide(s) of step (b).

A peptide or composition of the invention or component thereof may be produced by expressing a nucleic acid of the invention in a suitable host cell. The nucleic acid encoding the peptide/protein can be introduced into a host cell by any conventional technique. The host cells can e.g. be transfected, e.g. by conventional means such as electroporation with at least one expression vector containing a nucleic acid of the invention under the control of a transcriptional regulatory sequence. The transfected or transformed host cell is then cultured under conditions that allow expression of the protein. The expressed protein is recovered, isolated, and optionally purified from the cell (or from the culture medium, if expressed extracellularly) by appropriate means known to one of skill in the art. For example, the proteins are isolated in soluble form following cell lysis, or extracted using known techniques, e.g. in guanidine chloride. If desired, the peptides or fragments of the invention are produced as a fusion protein. Such fusion proteins are those described above. Alternatively, for example, it may be desirable to produce fusion proteins to enhance expression of the protein in a selected host cell or to improve purification. The molecules comprising the peptides and compositions of this invention may be further purified using any of a variety of conventional methods including, but not limited to: liquid chromatography such as normal or reversed phase, using HPLC, FPLC and the like; affinity chromatography (such as with inorganic ligands or monoclonal antibodies); size exclusion chromatography; immobilized metal chelate chromatography; gel electrophoresis; and the like. One of skill in the art may select the most appropriate isolation and purification techniques without departing from the scope of this invention. Such purification provides the peptide/protein/composition in a form substantially free from other proteinaceous and non-proteinaceous materials of the microorganism.

Still another subject of the invention relates to a pharmaceutical composition, especially a vaccine, comprising
(i) the composition according to the invention and/or at least one protective peptide according to the invention; and
(ii) optionally a pharmaceutically acceptable carrier or excipient.

A peptide or composition of the invention may be used for methods for immunizing or treating humans and/or animals with the disease caused by infection with S. agalactiae. Therefore, the peptide or composition may be used within a pharmaceutical composition. The pharmaceutical composition of the present invention may further encompass pharmaceutically acceptable carriers and/or excipients. The pharmaceutically acceptable carriers and/or excipients useful in this invention are conventional and may include buffers, stabilizers, diluents, preservatives, and solubilizers. Remington's Pharmaceutical Sciences, by E. W. Martin, Mack Publishing Co., Easton, Pa., 15th Edition (1975), describes compositions and formulations suitable for pharmaceutical delivery of the (poly)peptides/proteins herein disclosed.

If the pharmaceutical composition comprises at least two protective proteins as defined above, the proteins of subgroup i) to vi) may be formulated into one or more pharmaceutical composition(s). Additionally, the two or more pharmaceutical compositions may be administered together, simultaneously or consecutively.

In general, the nature of the carrier or excipients will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g. powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

In a preferred embodiment the pharmaceutical composition further comprises an immunostimulatory substance such as an adjuvant. The adjuvant can be selected based on the method of administration and may include mineral oil-based adjuvants such as Freund's complete and incomplete adjuvant, Montanide incomplete Seppic adjuvant such as ISA or ISA206 (SEPPIC, Paris, France), oil in water emulsion adjuvants such as the Ribi adjuvant system, syntax adjuvant formulation containing muramyl dipeptide, IC31® (Intercell; a synthetic adjuvant comprising the peptide motif KLK [WO 02/32451] and an oligonucleotide [WO 01/93905]), or aluminum salt adjuvants, preferably aluminum hydroxide or aluminum phosphate.

In a more preferred embodiment the immunostimulatory substance is selected from the group comprising polycationic polymers, especially polycationic peptides such as polyarginine, immunostimulatory deoxynucleotides (ODNs), especially Oligo(dIdC)$_{13}$, peptides containing at least two LysLeuLys motifs, especially KLKLLLLLKLK, neuroactive compounds, especially human growth hormone, alum, adjuvants and combinations thereof. Preferably the combination is either a polycationic polymer and immunostimulatory deoxynucleotides or of a peptide containing at least two LysLeuLys motifs and immunostimulatory deoxynucleotides. In a still more preferred embodiment the polycationic polymer is a polycationic peptide.

The term "Oligo(dIdC)$_{13}$" as used in the present invention means a phosphodiester backboned single-stranded. DNA molecule containing 13 deoxy (inosine-cytosine) motifs, also defined by the term [oligo-d(IC)$_{13}$]. The exact sequence is 5'-dIdCdIdCdIdCdIdCdIdCdIdCdIdC-dIdCdIdCdIdCdIdCdIdCdIdCdIdC-3'. Oligo(dIdC)$_{13}$ can also be defined by the terms (oligo-dIC$_{26}$); oligo-dIC$_{26\text{-}mer}$; oligo-deoxy IC, 26-mer; or oligo-dIC, 26-mer, as specified for example in WO 01/93903 and WO 01/93905.

In an even more preferred embodiment of the invention the immunostimulatory substance is at least one immunostimulatory nucleic acid. Immunostimulatory nucleic acids are e.g. natural or artificial CpG containing nucleic acids, short stretches of nucleic acids derived from non-vertebrates or in form of short oligonucleotides (ODNs) containing non-methylated cytosine-guanine dinucleotides (CpG) in a defined base context (e.g. as described in WO 96/02555). Alternatively, also nucleic acids based on inosine and cytidine as e.g. described in WO 01/93903, or deoxynucleic acids containing deoxy-inosine and/or deoxyuridine residues (described in WO 01/93905 and WO 02/095027) may preferably be used as immunostimulatory nucleic acids in the present invention. Preferably, mixtures of different immunostimulatory nucleic acids are used in the present invention. Additionally, the aforementioned polycationic compounds may be combined with any of the immunostimulatory nucleic acids as aforementioned. Preferably, such combinations are according to the ones described in WO 01/93905, WO 02/32451, WO 01/54720, WO 01/93903, WO 02/13857, WO 02/095027 and WO 03/047602.

In addition or alternatively, such a vaccine composition may comprise a neuroactive compound. Preferably, the neuroactive compound is human growth factor, e.g. described in WO 01/24822. Also preferably, the neuroactive compound is combined with any of the polycationic compounds and/or immunostimulatory nucleic acids as defined above.

In a highly preferred embodiment of the invention, the adjuvants are those used in the Examples, e.g. Complete Freund's adjuvant, aluminum hydroxide or/and an adjuvant comprising the KLKLLLLLKLK peptide and [dIdC]$_{13}$ phosphodiester ssDNA, such as IC31® (Intercell AG, Vienna, Austria; described above).

The composition may be used e.g. for immunization or treatment of a subject. The pharmaceutical composition encompasses at least one peptide or composition of the invention; however, it may also contain a cocktail (i.e., a simple mixture) containing different peptides and/or compositions of the invention, optionally mixed with different antigenic peptides or proteins of other pathogens. Such mixtures of these peptides, polypeptides, proteins or fragments or variants thereof are useful e.g. in the generation of desired antibodies to a wide spectrum of S. agalactiae isolates. The (poly)peptide(s)/composition(s) of the present invention may also be used in the form of a pharmaceutically acceptable salt. Suitable acids and bases which are capable of forming salts with the peptides of the present invention are well known to those of skill in the art, and include inorganic and organic acids and bases.

Still another subject of the invention relates to a pharmaceutical composition comprising
   (i) the one or more nucleic acid(s) according to the invention or one or more nucleic acid(s) complementary thereto, and
   (ii) optionally a pharmaceutically acceptable carrier or excipient.

The nucleic acid sequences, alone or in combination with other nucleic acid sequences encoding peptides/proteins/compositions or antibodies or directed to other pathogenic microorganisms, may further be used as components of a pharmaceutical composition. The composition may be used for immunizing or treating humans and/or animals with the disease caused by infection with S. agalactiae.

The pharmaceutically acceptable carrier or excipient may be as defined above.

In another embodiment, the nucleic acid sequences of this invention, alone or in combination with nucleic acid sequences encoding other antigens or antibodies from other pathogenic microorganisms, may further be used in compositions directed to actively induce a protective immune response in a subject to the pathogen. These components of the present invention are useful in methods for inducing a protective immune response in humans and/or animals against infection with S. agalactiae.

For use in the preparation of the therapeutic or vaccine compositions, nucleic acid delivery compositions and methods are useful, which are known to those of skill in the art. The nucleic acids of the present invention or one or more nucleic acid(s) complementary thereto may be employed in the methods of this invention or in the compositions described herein as DNA sequences, either administered as naked DNA, or associated with a pharmaceutically acceptable carrier and provide for in vivo expression of the antigen, peptide or polypeptide. So-called "naked DNA" may be used to express the peptide or composition of the invention in vivo in a patient. (See, e.g., J. Cohen, Science, 259:1691-1692, which describes similar uses of "naked DNA"). For example, "naked DNA" associated with regulatory sequences may be administered therapeutically or as part of the vaccine composition e.g., by injection.

Alternatively, a nucleic acid encoding a peptide or composition of the invention or a nucleic acid complementary thereto may be used within a pharmaceutical composition, e.g. in order to express the peptide or composition of the invention in vivo, e.g., to induce antibodies.

A preferred embodiment of the invention relates to a pharmaceutical composition, wherein the nucleic acid is comprised in a vector and/or a cell other than S. agalactiae. Vectors and cells suitable in the context of the present invention are described above. Vectors are particularly employed for a DNA vaccine. An appropriate vector for delivery may be readily selected by one of skill in the art. Exemplary vectors for in vivo gene delivery are readily available from a variety of academic and commercial sources, and include, e.g., adeno-associated virus (International patent application No. PCT/US91/03440), adenovirus vectors (M. Kay et al., Proc. Natl. Acad. Sci. USA, 91:2353 (1994); S. Ishibashi et al., J. Clin. Invest., 92:883 (1993)), or other viral vectors, e.g., various poxviruses, vaccinia, etc. Recombinant viral vectors, such as retroviruses or adenoviruses, are preferred for integrating the exogenous DNA into the chromosome of the cell.

Another subject of the invention relates to a method for producing antibodies, characterized by the following steps:
   (a) administering an effective amount of the composition according to the invention and/or at least one protective peptide according to the invention to an animal; and
   (b) isolating the antibodies produced by the animal in response to the administration of step (a) from the animal.

A further subject of the invention relates to a method for producing antibodies, characterized by the following steps:
   (a) contacting a B cell with an effective amount of the composition according to the invention and/or at least one protective peptide according to the invention;
   (b) fusing the B cell of step (a) with a myeloma cell to obtain a hybridoma cell; and
   (c) isolating the antibodies produced by the cultivated hybridoma cell.

Also included in the scope of the invention is the production of antibodies against a peptide or composition according to the invention. This includes, for example, monoclonal and polyclonal antibodies, chimeric, single chain, and humanized antibodies, as well as Fab fragments, or the product of a Fab expression library, which are able to specifically bind to the peptide or composition according to the invention.

In a preferred embodiment the antibody is a monoclonal, polyclonal, chimeric or humanized antibody or functionally active fragment thereof. In another preferred embodiment the functionally active fragment comprises a Fab fragment.

Antibodies generated against the peptide or composition according to the invention can be obtained by direct injection of the peptide or composition according to the invention into an animal or administering of the peptide or composition according to the invention to an animal, preferably a non-human. The antibody so obtained will then bind the peptide or composition according to the invention. Such antibodies can then be used to isolate reactive antigens, peptide or proteins from a tissue expressing those.

For preparation of monoclonal antibodies, any technique known in the art, which provides antibodies produced by continuous cell line cultures, e.g. a hybridoma cell line, can be used.

Techniques described for the production of single chain antibodies (U.S. Pat. No. 4,946,778) can be adapted to produce single chain antibodies to the antigenic peptides or compositions according to the invention. Also, transgenic mice or other organisms such as other mammals may be used to express humanized antibodies to the antigenic peptides or compositions according to the invention.

Antibodies may be also produced using a hybridoma cell line. Hybridoma cell lines expressing desirable monoclonal antibodies are generated by well-known conventional techniques. The hybridoma cell can be generated by fusing a normal-activated, antibody-producing B cell with a myeloma cell. In the context of the present invention the hybridoma cell is able to produce an antibody specifically binding to the antigenic peptide or composition according to the invention.

Similarly, desirable high titer antibodies are generated by applying known recombinant techniques to the monoclonal or polyclonal antibodies developed to these peptides/proteins/compositions (see, e.g., PCT Patent Application No. PCT/GB85/00392; British Patent Application Publication No. GB2188638A; Amit et al., Science, 233:747-753 (1986); Queen et al., Proc. Natl. Acad. Sci. USA, 86:10029-10033 (1989); PCT Patent Application No. WO90/07861; Riechmann et al., Nature, 332:323-327 (1988); Huse et al., Science, 246:1275-1281 (1988)).

Particularly, the antibody may be produced by initiating an immune response in a non-human animal by administrating a peptide or composition of the invention to an animal, removing an antibody-containing body fluid from said animal, and producing the antibodies by subjecting said antibodies containing body fluid to further purification steps.

Alternatively, the antibody may be produced by initiating an immune response in a non-human animal by administrating a peptide or composition, as defined in the present invention, to said animal, removing the spleen or spleen cells from said animal and/or producing hybridoma cells of said spleen or spleen cells, selecting and cloning hybridoma cells specific for the peptide or composition according to the invention and producing the antibody by cultivation of said cloned hybridoma cells.

Alternatively, the antibody may be produced employing a phage display antibody library. The method is based on the selective binding of one or more members of a phage display antibody library to a surface-bound antigen. The method may e.g. be carried out as follows: an antigen of choice is immobilized to a solid surface, such as nitrocellulose, magnetic beads, a column matrix or, the most widely used, plastic surfaces as polystyrole tubes or 96-well plates. The antibody phages are incubated with the surface-bound antigen, followed by thorough washing to remove the excess nonbinders. The bound antibody phage can subsequently be eluted and e.g. amplified by infection of *Escherichia coli*. This method allows the detection of a single antibody phage and as it can be selected by e.g. its resistance marker, it can give rise to a bacterial colony after elution. The isolation of antibodies using phage display antibody libraries has been described in more details by Mancini et al., New Microbiol. 2004 October; 27(4):315-328 and Pini et al., Curr Protein Pept Sci. 2004 December; 5(6):487-496.

In a preferred embodiment the antibodies produced according to a method of the invention are additionally purified. Methods of purification are known to the skilled artisan.

The antibody may be used in methods for treating an infection. Accordingly, still another subject of the invention relates to a pharmaceutical composition, especially a vaccine, comprising the antibody produced according to the invention. The pharmaceutical composition may encompass further components as detailed above. The composition may further encompass substances increasing their capacity to stimulate T cells. These include T helper cell epitopes, lipids or liposomes or preferred modifications as described in WO01/78767. Another way to increase the T cell stimulating capacity of epitopes is their formulation with immune stimulating substances for instance cytokines or chemokines like interleukin-2, -7, -12, -18, class I and H interferons (IFN), especially IFN-gamma, GM-CSF, TNF-alpha, flt3-ligand and others.

Another subject of the invention relates to a mixture of antibodies against the at least two proteins of the composition according to the invention and/or against the at least one protective peptide according to the invention. The mixture of antibodies may be further characterized and produced as described above.

Methods of producing antibodies, mixtures of antibodies, as well as the use of antibodies are also described in Examples 4 and 5, and FIGS. 4, 8, and 10 to 13.

Another subject of the invention relates to the use of the composition according to the invention and/or at least one protective peptide according to the invention and/or one or more of the nucleic acid(s) according to the invention for the manufacture of a medicament for the immunization or treatment of a subject, preferably against *S. agalactiae*, more preferably against pneumonia, septicemia, meningitis, fever, vomiting, poor feeding, irritability, urinary tract infection and/or vaginal infection caused by *S. agalactiae*.

The peptides, proteins, compositions or the nucleic acids of the invention are generally useful for inducing an immune response in a subject. The vaccine used for immunization may be administered to a subject susceptible to infection by *S. agalactiae*, preferably mammals, and still more preferably humans, in any conventional manner, including oral, topical, intranasal, intramuscular, intra-lymph node, intradermal, intraperitoneal, subcutaneous, and combinations thereof, but most preferably through intramuscular injection. The volume of the dose for intramuscular administration is preferably up to about 5 ml, still more preferably between 0.5 ml and 3 ml, and most preferably about 1 to 2 ml. The volume of the dose when subcutaneous injection is the selected administration route is preferably up to about 5 ml, still more preferably between 0.5 ml and 3 ml, and most preferably about 1 to 2 ml. The amount of substance in each dose should be enough to confer effective immunity against and decrease the risk of developing clinical signs resulting from *S. agalactiae* infection to a subject receiving a vaccination therewith. Preferably, the unit dose of protein should be up to about 5 µg protein/kg body weight, more preferably between about 0.2 to 3 µg, still more preferably between about 0.3 to 1.5 µg, more preferably between about 0.4 to 0.8 µg, and still more preferably about 0.6 µg.

Alternative preferred unit doses of protein could be up to about 6 µg protein/kg body weight, more preferably between about 0.05 to 5 µg, still more preferably between about 0.1 to 4 µg. The dose is preferably administered 1 to 3 times, e.g. with an interval of 1 to 4 weeks. Preferred amounts of protein per dose are from approximately 1 µg to approximately 1 mg, more preferably from approximately 5 µg to approximately 500 µg, still more preferably from approximately 10 µg to approximately 250 µg and most preferably from approximately 25 µg to approximately 100 µg.

In still another aspect of the invention the mixture of antibodies or the antibody produced according to the invention or functional fragment thereof is used for the manufacture of a medicament for the treatment of an infection, preferably a *S. agalactiae* infection. The treatment involves administering an effective amount of the antibody to a subject, preferably a mammal, more preferably a human. Thus, antibodies against the peptides or the composition of the present invention may be employed to inhibit and/or treat infections, particularly bacterial infections and especially infections arising from *S. agalactiae*.

An "effective amount" of peptides, proteins, compositions or the nucleic acids of the invention or an antibody produced according to the invention may be calculated as that amount capable of exhibiting an in vivo effect, e.g. preventing or ameliorating a sign or symptom of infection, particularly *S. agalactiae* infection. Such amounts may be determined by one of skill in the art. Such a substance may be administered in any conventional manner, including oral, topical, intranasal, intramuscular, intra-lymph node, intradermal, intraperitoneal, subcutaneous, and combinations thereof, but preferably intramuscularly or subcutaneously. However, it may also be formulated to be administered by any other suitable route, including orally or topically. The selection of the route of delivery and dosage of such therapeutic compositions is within the skill of the art.

Treatment in the context of the present invention refers to both therapeutic treatment and prophylactic or preventive measures, wherein the object is to prevent or slow down (lessen) the targeted pathologic condition or disorder. Those in need of treatment include those already with the disorder as well as those prone to have the disorder or those in whom the disorder is to be prevented.

Another subject of the invention relates to a method of diagnosing a *S. agalactiae* infection comprising the steps of:
(a) contacting a sample obtained from a subject with the composition according to the invention and/or at least one protective peptide according to the invention; and
(b) detecting the presence of an antibody against the protective peptide, the functionally active variant and/or the composition in the sample, wherein the presence of the antibody is indicative for the *S. agalactiae* infection.

Another subject of the invention relates to a method of diagnosing a *S. agalactiae* infection comprising the steps of:
(a) contacting a sample obtained from a subject with the mixture of antibodies according to the invention; and
(b) detecting the presence of the at least two proteins of the composition according to the invention and/or of the at least one protective peptide according to the invention in the sample, wherein the presence of the at least two proteins and/or of the at least one protective peptide is indicative for the *S. agalactiae* infection.

The protective peptides or compositions of the invention or alternatively a mixture of antibodies may be used for the detection of *S. agalactiae*. Preferably such detection is for diagnosis, more preferably for the diagnosis of a disease, most preferably for the diagnosis of a *S. agalactiae* infection. The protective peptides or compositions may be used to detect the presence of a *S. agalactiae*-specific antibody or fragment thereof e.g. in a sample obtained from a subject. Alternatively, the mixture of antibodies may be used to detect the presence of *S. agalactiae* proteins, e.g. in a sample obtained from a subject. The sample may be e.g. a blood sample.

The present invention also relates to diagnostic assays such as quantitative and diagnostic assays for detecting levels of the proteins, compositions and/or mixtures of antibodies of the present invention in cells and tissues or body fluids, including determination of normal and abnormal levels. Assay techniques that can be used to determine levels of a peptide, a composition or an antibody, in a sample derived from a host are well known to those of skill in the art. Such assay methods include radioimmunoassays, competitive-binding assays, Western Blot analysis and ELISAs. Among these, ELISAs frequently are preferred.

An ELISA initially comprises preparing an antibody or antibodies specific to the peptide or composition, preferably a monoclonal antibody. In addition, a reporter antibody generally is prepared which binds to the monoclonal antibody. The reporter antibody is attached to a detectable reagent such as radioactive, fluorescent or enzymatic reagent, such as horseradish peroxidase enzyme.

The peptides or compositions of the present invention may also be used for the purpose of or in connection with an array. More particularly, at least one of the peptides or compositions of the present invention may be immobilized on a support. Said support typically comprises a variety of peptides/proteins whereby the variety may be created by using one or several of the peptides or compositions of the present invention. The characterizing feature of such array as well as of any array in general is the fact that at a distinct or predefined region or position on said support or a surface thereof, a distinct polypeptide is immobilized. Because of this any activity at a distinct position or region of an array can be correlated with a specific polypeptide. The number of different peptides or antibodies of the present invention immobilized on a support may range from as little as 10 to several 1000 different peptides or compositions of the present invention. Alternatively, antibodies produced according to the present invention may be used to detect peptides or compositions of the invention.

The manufacture of such arrays is known to the one skilled in the art and, for example, described in U.S. Pat. No. 5,744, 309. The array preferably comprises a planar, porous or non-porous solid support having at least a first surface. Preferred support materials are, among others, glass or cellulose. It is also within the present invention that the array is used for any of the diagnostic applications described herein. Apart from the peptides or antibodies of the present invention also the nucleic acid molecules according to the present invention may be used for the generation of an array as described above.

Another subject of the invention relates to a method for diagnosing an infection with *S. agalactiae* comprising the steps of:
(a) contacting a sample obtained from a subject with a primer and/or a probe specific for the one or more nucleic acid(s) according to the invention; and
(b) detecting the presence of one or more nucleic acid(s) according to the invention in the sample, wherein the presence of the one or more nucleic acid(s) is indicative for the *S. agalactiae* infection.

A series of methods for detecting nucleic acids in samples by using specific primers and/or probes is known in the art. In general, these methods are based on the specific binding of a primer or probe to the nucleic acid in question. The methods may involve amplification of the nucleic acid, e.g. RNA or DNA, before the actual detection step. Therefore, primers may be used to specifically induce transcription and/or amplification of RNA or DNA in order to generate a detectable amount of nucleic acid. Suitable well known techniques may be PCR and RT-PCR. Suitable primers and probes for the method of the invention may be produced based on sequence information provided in the present application. Guidelines and computer-assisted programs (e.g. Primer Express®, Applied Biosystems, Foster City, Calif., USA) for designing primers and probes to a specific nucleic acid are known to the person skilled in the art.

After the amplification step the amplified nucleic acid, in general DNA, may be detected e.g. by its size (e.g. involving agarose gel electrophoresis) or using labeled probes which specifically bind to the amplified nucleic acid. The probes may be labeled with a dye, radioactive marker, a fluorescent marker, an enzyme-linked marker or any other marker.

For example, FRET (Förster resonance energy transfer) may be used for the detection of the nucleic acid of the invention. In FRET, a donor fluorophore molecule absorbs excitation energy and delivers this via dipole-dipole interaction to a nearby acceptor fluorophore molecule. This process only occurs when the donor and acceptor molecules are sufficiently close to one another. Several different strategies for determining the optimal physical arrangement of the donor and acceptor moieties are known to the skilled practitioner. For this, a fluorescent donor is excited at its specific fluorescence excitation wavelength. By a long-range dipole-dipole coupling mechanism, this excited state is then nonradiatively transferred to a second molecule, the acceptor. The donor returns to the electronic ground state. The described energy transfer mechanism is termed "Förster resonance energy transfer" (FRET). The process involves measuring fluorescence as FRET donor and acceptor moieties are brought together as a result of DNA hybridization. For examples two probes each labeled with a suitable marker hybridize to the nucleic acid of the invention within a distance which allows FRET to occur. Suitable markers include Cyan 500, Cy5, Cy3, SYBR Green I, fluorescein, HEX, Red 610 and Red 640, wherein the two marker involved have to be selected based on there excitation and emission spectrums as known by the skilled person. A suitable system for the detection of nucleic acids is the LightCycler® (Roche Diagnostics).

Another subject of the invention relates to a method for identifying a ligand capable of binding the composition according to the invention and/or at least one protective peptide according to the invention comprising:
  (a) providing a test system comprising the peptide and/or composition,
  (b) contacting the test system with a test compound, and
  (c) detecting a signal generated in response to the binding of the test compound to the peptide and/or composition.

More particularly, the method may be carried out by contacting an isolated or immobilized protective peptide or composition according to the invention with a candidate ligand under conditions to permit binding of the candidate ligand to the peptide, wherein the test system comprises a component capable of providing a detectable signal in response to the binding of the candidate ligand to said peptide; and detecting the presence or absence of a signal generated in response to the binding of the ligand to the peptide. The ligand may be an agonist or an antagonist.

Test systems for detection binding of a ligand are known to the skilled artisan and include e.g. binding assays with labeled ligand such as radioligands, fluorescence-labeled ligands or enzyme-labeled ligands.

The test compound can be any test compound either naturally occurring or chemically synthesized. Naturally occurring test compounds include in particular antibodies, preferably those showing similarity to the antibodies of the invention. In one preferred embodiment of the invention the test compound is provided in the form of a chemical compound library. Chemical compound libraries include a plurality of chemical compounds and have been assembled from any of multiple sources, including chemically synthesized molecules and natural products, or have been generated by combinatorial chemistry techniques. They are especially suitable for high throughput screening. They may be comprised of chemical compounds of a particular structure or compounds of a particular creature such as a plant.

A further subject of the invention relates to the use of the composition according to the invention and/or at least one protective peptide according to the invention for the isolation and/or purification and/or identification of an interaction partner of the composition and/or peptide. The isolation and/or purification and/or identification of the ligand may be carried out as detailed above or as known to the person skilled in the art. In a preferred embodiment of the invention an affinity device may be used. The affinity device may comprise at least a support material and any antigenic peptide or composition according to the present invention, which is attached to the support material. Because of the specificity of the protective peptides and/or compositions according to the present invention for their target cells or target molecules or their interaction partners, the peptides and/or compositions allow a selective removal of their interaction partner(s) from any kind of sample applied to the support material provided that the conditions for binding are met. The sample may be a biological or medical sample, including but not limited to, fermentation broth, cell debris, cell preparation, tissue preparation, organ preparation, blood, urine, lymph liquid, liquor and the like. The peptide or composition may be attached to the matrix in a covalent or non-covalent manner. Suitable support material is known to the one skilled in the art and can be selected from the group comprising cellulose, silicon, glass, aluminium, paramagnetic beads, starch and dextrane.

The present invention is further illustrated by the following Figures, Examples and the Sequence listing, from which further features, embodiments and advantages may be taken. It is to be understood that the present examples are given by way of illustration only and not by way of limitation of the disclosure.

BRIEF DESCRIPTION OF THE DRAWINGS

FIG. 5A-D show the sequence alignment of protein sequences homologous to gbs1477 from genomic and sequenced strains. Alignment of sequences was performed using the software from Vector NTI (Suite 7.1; Invitrogen, Austria). The name on the left of the sequence indicates the strain name. Amino acids in bold, residue identical in at least 50% of sequences. *, indicates position of STOP codon.

EXAMPLES

Example 1

Figure 1:
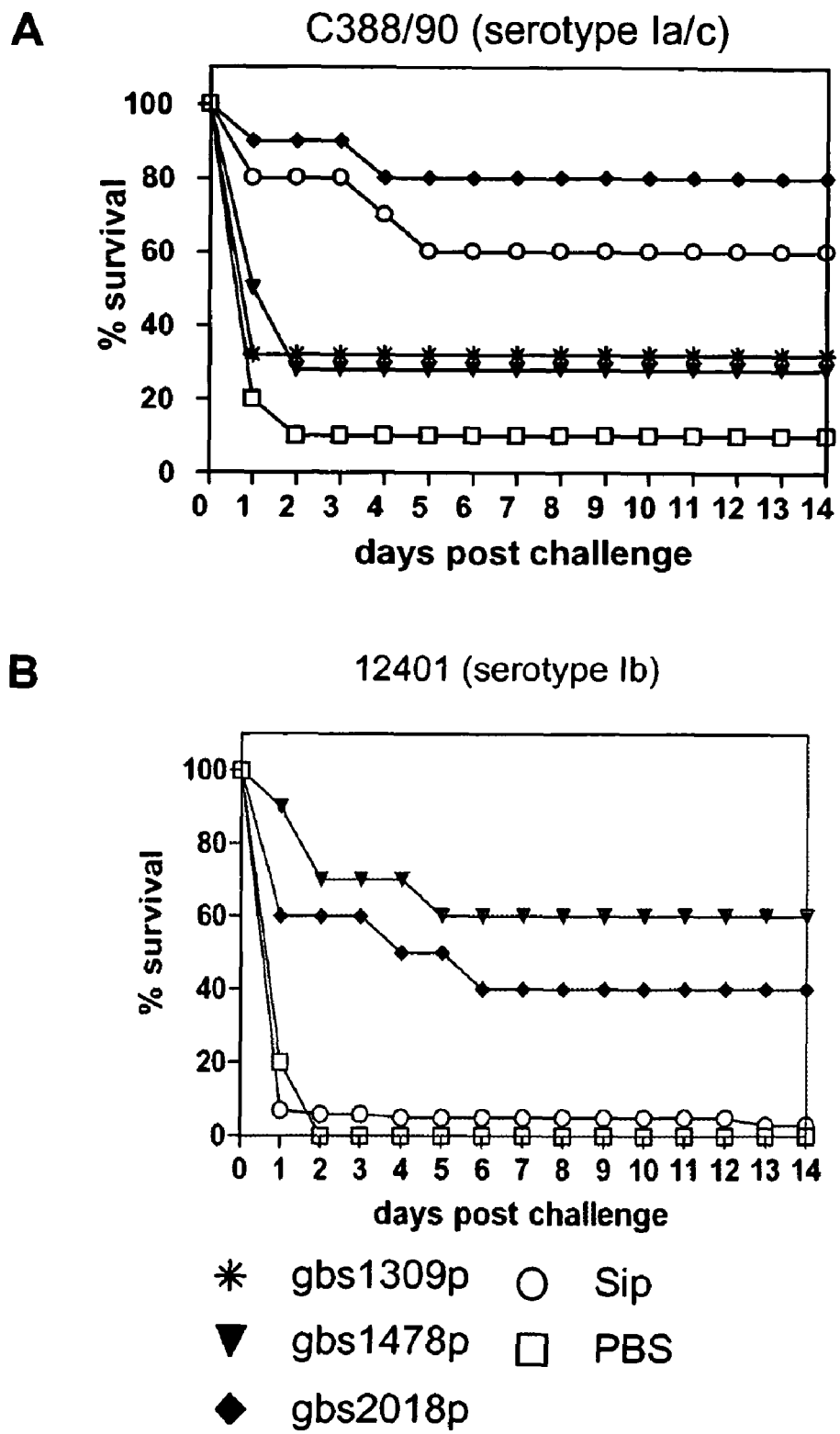
FIG. 1 shows the protection achieved by passive immunization with selected hyper-immune rabbit sera generated by immunization of rabbits with *S. agalactiae* antigens in a mouse lethality model. CD-1 mice (10 mice per group) were immunized intraperitoneally with 150 µl hyper-immune rabbit sera 1-3 hours before they were intraperitoneally challenged. (A) gbs1309p, gbs1478p, gbs2018p, Sip and PBS-induced hyperimmune sera, challenge with $1\times10^7$ cfu C388/90 (serotype Ia/c). (B) gbs1478p, gbs2018p, Sip and PBS-induced hyperimmune sera, challenge with $5\times10^6$ cfu ATCC12401 (serotype Ib). (C) gbs0233p, gbs1087p, gbs1477p, Sip and PBS-induced hyperimmune sera, challenge with $1\times10^8$ cfu ATCC12403 (serotype III). (D) gbs0233p, gbs1087p, gbs2018p, Sip and PBS-induced hyperimmune sera, challenge with $1\times10^8$ cfu ATCC49447 (serotype V). Survival was monitored for 14 days post-challenge. Numbers of surviving mice are plotted as percentage of total mice.

Group B Streptococcal Antigens and Combinations Thereof Inducing Protective Immune Responses Against Lethal Sepsis in an i.p. Challenge Model Experimental Procedures
Cloning and Expression of Recombinant Group B Streptococcal Proteins Cloning of genes: The gene of interest was amplified from genomic DNA of *S. agalactiae* ATCC12403 (serotype by PCR using gene specific primers. Apart from the gene specific part, the primers had restriction sites that aided in a directional cloning of the amplified PCR product. The gene annealing (specific) part of the primer ranged between 15-30 bases in length. The PCR products obtained were digested with the appropriate restriction enzymes and cloned into the pET28b (+) vector (Novagen) for His-tagged proteins. Once the recombinant plasmid was confirmed to contain the gene of interest, *E. coli* BL21 star® cells (Invitrogen) that served as expression host were transformed. Cloning of the gbs1087, gbs1477 and gbs1478 genes has been performed using genomic DNA from strain *S. agalactiae* 6313 (serotype III) in the vector pET28a (+). The origin of the gene and position within the full length gene of the selected antigens are listed in Table 1. The amino acid and nucleic acid sequences are as follows:

Amino Acid Sequences:

Construct 1: gbs0233p

SEQ ID NO: 1

LCLALLTISGCQLTDTKKPGHTTIKVAAQSSTESSIMANIVTELIHHELGYNTTLISNLGS

STVTHQALLRGDADIAATRYTGTDITGTLGLKAVKDTKEASKIVKTEFQKRYNQTWYPTYG

FSDTYAFMVTKEFARQNKITKISDLKKLSTTMKAGVDSSWMNREGDGYTDFAKTYGFEFSH

IYPMQIGLVYDAVESNKMQSVLGYSTDGRISSYDLEILRDDKKFFPPYEASMVVNNSIIKK

DPKLKKLLHRLDGKINLKTMQNLNYMVDDKLLEPSVVAKQFLEKNHYFRGD

Construct 2: gbs1087p
SEQ ID NO: 2

MDSVGNQSQGNVLERRQRDAENRSQGNVLERRQRDVENKSQGNVLERRQRDAENKSQGNVL

ERRQRDAENRSQGNVLERRQRDAENRSQGNVLERRQRDAENRSQGNVLERRQRDAENRSQG

NVLERRQRDAENRSQGNVLERRQRDVENKSQGNVLERRQRDAENKSQGNVLERRQRDAENR

SQGNVLERRQRDAENRSQGNVLERRQRDAENRSQGNVLERRQRDAENRSQGNVLERRQRDA

ENRSQGNVLERRQRDAENRSQGNVLERRQRDAENRSQGNVLERRQRDAENRSQGNVLERRQ

RDAENKSQVGQLIG

Construct 3: gbs1309p
SEQ ID NO: 3

SVTYSQSERTVVFSFGEITFSRSRWTNGFETRIPVDEWLGLEKYKRYSIEFLYHVAKLATM

MPYRQVCKVIDSTLQTIITKDCVLKAVKFVEKLLKEKERYRFYLEEPPERKKVKKLYVEGD

GVMIKSTDSREERRYLDLTHFVIHTGSKKVSTKRYELQDKHEILQLNYDKAKYNLLDYIYN

NYEVDDDTILITNSDMGKGYTSRVFKELGKALKVKKHEHFWDIYHVKEKLSSYLRKYPIEL

TDFALDAVKKYNSDKLELVFDTVESLICDELEDQEFQKFKKKVLNNFKYIKPAHLRNLSNR

GIGIMESQHRKITYRMKRRGMYWSKWGISTMANMIILERANGLRELFFGSWRKVYSEYKEG

SFSAGRLFKKTDELDKFSKPLLKNGRKWSITGIK

Construct 4: gbs1477p
SEQ ID NO: 4

DDVTTDTVTLHKIVMPQAAFDNFTEGTKGKNDSDYVGKQINDLKSYFGSTDAKEIKGAFFV

FKNETGTKFITENGKEVDTLEAKDAEGGAVLSGLTKDTGFAFNTAKLKGTYQIVELKEKSN

YDNNGSILADSKAVPVKITLPLVNNQGVVKDAHIYPKNTETKPQVDKNFADKDLDYTDNRK

DKGVVSATVGDKKEYIVGTKILKGSDYKKLVWTDSMTKGLTFNNNVKVTLDGKDFPVLNYK

LVTDDQGFRLALNATGLAAVAAAAKDKDVEIKITYSATVNGSTTVEVPETNDVKLDYGNNP

TEESEPQEGTPANQEIKVIKDWAVDGTITDVNVAVKAIFTLQEKQTDGTWVNVASHEATKP

SRFEHTFTGLDNTKTYRVVERVSGYTPEYVSFKNGVVTIKNNKNSNDPTPINPSEPKVVTY

GRKFVKTNQANTERLAGATFLVKKEGKYLARKAGAATAEAKAAVKTAKLALDEAVKAYNDL

TKEKQEGQEGKTALATVDQKQKAYNDAFVKANYSYEWVADKKADNVVKLISNAGGQFEITG

LDKGTYSLEETQAPAGYATLSGDVNFEVTATSYSKGATTDIAYDKGSVKKDAQQVQNKKVT

IPQTGGIGT

Construct 5: gbs1478p
SEQ ID NO: 5

ESTVPENGAKGKLVVKKTDDQNKPLSKATFVLKTTAHPESKIEKVTAELTGEATFDNLIPG

DYTLSEETAPEGYKKTNQTWQVKVESNGKTTIQNSGDKNSTIGQNHEELDKQYPPTGIYED

TKESYKLEHVKGSVPNGKSEAKAVNPYSSEGEHIREIPEGTLSKRISEVGDLAHNKYKIEL

TVSGKTIVKPVDKQKPLDVVFVLDNSNSMNNDGPNFQRHNKAKKAAEALGTAVKDILGANS

DNRVALVTYGSDIFDGRSVDVVKGFKEDDKYYGLQTKFTIQTENYSHKQLTNNAEEIIKRI

PTEAPRAKWGSTTNGLTPEQQKQYYLSKVGETFTMKAFMEADDILSQVDRNSQKIIVHITD

GVPTRSYAINNFKLGASYESQFEQMKKNGYLNKSNFLLTDKPEDIKGNGESYFLFPLDSYQ

TQIISGNLQKLHYLDLNLNYPKGTIYRNGPVREHGTPTKLYINSLKQKNYDIFNFGIDISA

FRQVYNEDYKKNQDGTFQKLKEEAFELSDGEITELMKSFSSKPEYYTPIVTSSDASNNEIL

SKIQQQFEKVLTKENSIVNGTIEDPMGDKINLQLGNGQTLQPSDYTLQGNDGSIMDSIAT

-continued

```
GGPNNDGGILKGVKLEYIKNKLYVRGLNLGEGQKVTLTYDVKLDDSFISNKFYDTNGRTTL

NPKSEDPNTLRDFPIPKIRDVREYPTITIKNEKKLGEIEFTKVDKDNNKLLLKGATFELQE

FNEDYKLYLPIKNNNSKVVTGENGKISYKDLKDGKYQLIEAVSPKDYQKITNKPILTFEVV

KGSIQNIIAVNKQISEYHEEGDKHLITNTHIPPKGIIPMTGGK
```

Construct 6: gbs2018p

SEQ ID NO: 6

```
DTSSGISASIPHKKQVNLGAVTLKNLISKYRGNDKAIAILLSRVNDFNRASQDTLPQLINS

TEAEIRNILYQGQIGKQNKPSVTTHAKVSDQELGKQSRRSQDIIKSLGFLSSDQKDILVKS

ISSSKDSQLILKFVTQATQLNNAESTKAKQMAQNDVALIKNISPEVLEEYKEKIQRASTKS

QVDEFVAEAKKVVNSNKETLVNQANGKKQEIAKLENLSNDEMLRYNTAIDNVVKQYNEGKL

NITAAMNALNSIKQAAQEVAQKNLQKQYAKKIERISSKGLALSKKAKEIYEKHKSILPTPG

YYADSVGTYLNRFRDKQTFGNRSVWTGQSGLDEAKKMLDEVKKLLKELQDLTRGTKEDKKP

DVKPEAKPEAKPNIQVPKQAPTEAAKPALSPEALTRLTTWYNQAKDLLKDDQVKDKYVDIL

AVQKAVDQAYDHVEEGKFITTDQANQLANKLRDALQSLELKDKKVAKPEAKPEAKPEAKPE

AKPEAKPEAKPEAKPDVKPEAKPDVKPEAKPEAKPEAKSEAKPEAKLEAKPEAKPAT

KKSVNTSGNLAAKKAIENKKYSKKLPST
```

Nucleic Acid Sequences:

Construct 1: gbs0233p

SEQ ID NO: 7

```
CTTTGCTTAGCCCTCTTAACGATTTCTGGTTGTCAATTAACCGATACTAAAAAACCTGGTC

ATACCACAATTAAGGTTGCTGCCCAAAGTTCTACAGAGTCTAGTATCATGGCAAATATTGT

CACCGAATTAATTCATCACGAATTAGGATACAACACAACTTTAATAAGCAATCTTGGTTCC

TCTACGGTTACTCACCAAGCTTTGCTCCGTGGTGATGCTGACATTGCTGCCACACGTTATA

CAGGAACAGACATCACAGGAACTCTTGGCTTAAAAGCTGTTAAAGACACTAAAGAAGCTTC

TAAGATTGTAAAAACTGAATTCCAAAAACGCTACAATCAAACTTGGTATCCTACTTATGGT

TTTTCTGATACTTATGCATTCATGGTTACTAAAGAGTTTGCCAGACAGAATAAAATCACCA

AGATCTCTGATCTCAAAAAGTTATCAACAACTATGAAGGCAGGGGTTGATAGTTCATGGAT

GAATCGCGAGGGAGATGGATACACTGATTTCGCTAAAACATACGGTTTTGAATTTTCACAT

ATTTACCCTATGCAAATTGGCTTAGTCTATGATGCAGTTGAAAGTAACAAAATGCAATCTG

TATTAGGCTACTCCACTGACGGTCGTATTTCGAGCTATGATTTAGAAATTTTAAGGGATGA

TAAAAAATTCTTTCCTCCTTATGAAGCCTCTATGGTTGTCAACAATTCTATCATCAAAAAA

GATCCTAAACTAAAAAAATTACTCCATCGACTCGATGGTAAAATCAATTTAAAAACGATGC

AAAACCTTAATTATATGGTAGATGATAAACTTTTAGAACCTTCAGTTGTTGCCAAACAATT

TTTAGAAAAAAACCATTATTTTAGAGGAGAT
```

Construct 2: gbs1087p

SEQ ID NO: 8

```
ATGGATAGTGTTGGAAATCAAAGTCAGGGCAATGTTTTAGAGCGTCGTCAACGTGATGCAG

AAAACAGAAGCCAAGGCAATGTTCTAGAGCGTCGTCAACGCGATGTTGAGAATAAGAGCCA

AGGCAATGTTTTAGAGCGTCGTCAACGTGATGCGGAAAACAAGAGCCAAGGCAATGTTTTA

GAGCGTCGTCAACGTGATGCAGAAAACAGAAGCCAAGGCAATGTTCTAGAGCGTCGTCAAC

GTGATGCAGAAAACAGAAGCCAAGGCAATGTTCTAGAGCGTCGTCAACGCGATGCAGAAAA

CAGAAGCCAAGGTAATGTTCTAGAGCGTCGTCAACGTGATGCAGAAAACAGAAGCCAAGGT
```

-continued
```
AATGTTCTAGAGCGTCGTCAACGTGATGCAGAAAACAGAAGCCAAGGTAATGTTCTAGAGC

GTCGTCAACGCGATGTTGAGAATAAGAGCCAAGGCAATGTTTTAGAGCGTCGTCAACGTGA

TGCGGAAAACAAGAGCCAAGGCAATGTTTTAGAGCGTCGTCAACGTGATGCAGAAAACAGA

AGCCAAGGCAATGTTTTAGAGCGTCGTCAACGTGATGCAGAAAACAGAAGCCAAGGCAATG

TTCTAGAGCGTCGTCAACGTGATGCAGAAAACAGAAGCCAAGGCAATGTTCTAGAGCGTCG

TCAACGTGATGCAGAAAACAGAAGCCAAGGCAATGTTCTAGAGCGTCGTCAACGCGATGCA

GAAAACAGAAGCCAAGGTAATGTTCTAGAGCGTCGTCAACGTGATGCAGAAAACAGAAGCC

AAGGCAATGTTTTAGAGCGTCGTCAACGTGATGCAGAAAACAGAAGCCAAGGCAATGTTTT

AGAGCGTCGTCAACGTGATGCAGAAAACAGAAGCCAAGGCAATGTTTTAGAGCGTCGTCAA

CGTGATGCGGAAAACAAGAGCCAAGTAGGTCAACTTATAGGG
```

Construct 3: gbs1309p

SEQ ID NO: 9
```
AGTGTAACCTATTCACAGTCTGAACGTACGGTTGTTTTCTCTTTTGGAGAAATAACATTTA

GTAGGAGTCGCTGGACAAATGGCTTTGAAACTAGAATACCAGTAGATGAGTGGTTAGGTCT

TGAAAAATATAAGAGATATTCAATAGAATTCTTATATCATGTTGCAAAATTGGCTACAATG

ATGCCTTATCGTCAAGTTTGCAAAGTAATAGATAGCACTTTGCAAACAATCATAACAAAAG

ACTGTGTTTTAAAAGCAGTAAAATTTGTAGAAAAATTGTTAAAAGAAAAAGAACGCTATCG

TTTTTATTTGGAAGAGCCACCCGAACGTAAAAAAGTGAAAAAACTGTATGTTGAGGGTGAT

GGAGTCATGATTAAAAGCACAGATTCTAGAGAGGAAAGAAGGTATTTAGATTTAACACATT

TTGTTATTCATACAGGCTCAAAAAAAGTTTCTACTAAAAGATATGAATTGCAGGACAAGCA

CGAAATATTACAGCTTAATTATGATAAAGCTAAATATAATCTTTTAGATTATATTTATAAT

AACTATGAAGTAGATGACGATACTATTTTAATCACTAACTCTGATATGGGTAAAGGCTATA

CTAGTAGAGTTTTTAAGGAATTAGGAAAAGCACTTAAGGTAAAGAAACATGAGCATTTTTG

GGATATCTATCATGTTAAAGAAAAGTTAAGTTCATACCTTAGAAAATATCCAATTGAATTA

ACCGATTTTGCTTTAGATGCGGTAAAAAAATATAATTCTGATAAGCTTGAATTAGTTTTTG

ATACTGTTAATCACTGATTTGTGATGAACTTGAAGATCAAGAATTTCAGAAGTTTAAGAA

AAAAGTATTAAATAATTTCAAATATATAAAACCAGCTCATCTTAGAAATCTTTCAAATCGT

GGTATTGGTATCATGGAATCACAACACAGAAAGATAACGTATAGAATGAAGCGACGTGGCA

TGTATTGGTCAAAGTGGGGAATCTCCACAATGGCAAATATGATTATACTTGAAAGAGCTAA

CGGTTTACGAGAATTATTTTTCGGTTCTTGGAGAAAGGTATACAGTGAGTATAAAGAAGGT

TCATTTAGTGCAGGGCGACTTTTTAAAAAGACAGATGAATTAGATAAATTTTCTAAGCCCC

TTCTAAAAAATGGCAGAAAATGGAGTATAACAGGAATCAAA
```

Construct 4: gbs1477p

SEQ ID NO: 10
```
GACGACGTAACAACTGATACTGTGACCTTGCACAAGATTGTCATGCCACAAGCTGCATTTG

ATAACTTTACTGAAGGTACAAAAGGTAAGAATGATAGCGATTATGTTGGTAAACAAATTAA

TGACCTTAAATCTTATTTTGGCTCAACCGATGCTAAAGAAATTAAGGGTGCTTTCTTTGTT

TTCAAAAATGAAACTGGTACAAAATTCATTACTGAAAATGGTAAGGAAGTCGATACTTTGG

AAGCTAAAGATGCTGAAGGTGGTGCTGTTCTTTCAGGGTTAACAAAAGACACTGGTTTTGC

TTTTAACACTGCTAAGTTAAAAGGAACTTACCAAATCGTTGAATTGAAAGAAAAATCAAAC

TACGATAACAACGGTTCTATCTTGGCTGATTCAAAAGCAGTTCCAGTTAAAATCACTCTGC

CATTGGTAAACAACCAAGGTGTTGTTAAAGATGCTCACATTTATCCAAAGAATACTGAAAC

AAAACCACAAGTAGATAAGAACTTTGCAGATAAAGATCTTGATTATACTGACAACCGAAAA
```

-continued

```
GACAAAGGTGTTGTCTCAGCGACAGTTGGTGACAAAAAAGAATACATAGTTGGAACAAAAA

TTCTTAAAGGCTCAGACTATAAGAAACTGGTTTGGACTGATAGCATGACTAAAGGTTTGAC

GTTCAACAACAACGTTAAAGTAACATTGGATGGTAAAGATTTTCCTGTTTTAAACTACAAA

CTCGTAACAGATGACCAAGGTTTCCGTCTTGCCTTGAATGCAACAGGTCTTGCAGCAGTAG

CAGCTGCTGCAAAAGACAAAGATGTTGAAATCAAGATCACTTACTCAGCTACGGTGAACGG

CTCCACTACTGTTGAAGTTCCAGAAACCAATGATGTTAAATTGGACTATGGTAATAACCCA

ACGGAAGAAAGTGAACCACAAGAAGGTACTCCAGCTAACCAAGAAATTAAAGTCATTAAAG

ACTGGGCAGTAGATGGTACAATTACTGATGTTAATGTTGCAGTTAAAGCTATCTTTACCTT

GCAAGAAAACAAACGGATGGTACATGGGTGAACGTTGCTTCACACGAAGCAACAAAACCA

TCACGCTTTGAACATACTTTCACAGGTTTGGATAATACTAAAACTTACCGCGTTGTCGAAC

GTGTTAGCGGCTACACTCCAGAATATGTATCATTTAAAAATGGTGTTGTGACTATCAAGAA

CAACAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCC

TTGTTAAGAAAGAAGGAAAATACTTGGCACGTAAAGCAGGTGCAGCAACTGCTGAAGCAAA

GGCAGCTGTAAAAACTGCTAAACTAGCATTGGATGAAGCTGTTAAAGCTTATAACGACTTG

ACTAAAGAAAAACAAGAAGGCCAAGAAGGTAAAACAGCATTGGCTACTGTTGATCAAAAAC

AAAAAGCTTACAATGACGCTTTTGTTAAAGCTAACTACTCATATGAATGGGTTGCAGATAA

AAAGGCTGATAATGTTGTTAAATTGATCTCTAACGCCGGTGGTCAATTTGAAATTACTGGT

TTGGATAAAGGCACTTATAGCTTGGAAGAAACTCAAGCACCAGCAGGTTATGCGACATTGT

CAGGTGATGTAAACTTTGAAGTAACTGCCACATCATATAGCAAAGGGGCTACAACTGACAT

CGCATATGATAAAGGATCTGTAAAAAAAGATGCCCAACAAGTTCAAAACAAAAAGTAACC

ATCCCACAAACAGGTGGTATTGGTACA
```

Construct 5: gbs1478p

SEQ ID NO: 11

```
GAAAGTACCGTACCGGAAAATGGTGCTAAAGGAAAGTTAGTTGTAAAAAGACAGATGACC

AGAACAAACCACTTTCAAAAGCTACCTTTGTTTTAAAAACTACTGCTCATCCAGAAAGTAA

AATAGAAAAAGTAACTGCTGAGCTAACAGGTGAAGCTACTTTTGATAATCTCATACCTGGA

GATTATACTTTATCAGAAGAAACAGCGCCCGAAGGTTATAAAAAGACTAACCAGACTTGGC

AAGTTAAGGTTGAGAGTAATGGAAAAACTACGATACAAAATAGTGGTGATAAAAATTCCAC

AATTGGACAAAATCACGAAGAACTAGATAAGCAGTATCCCCCCACAGGAATTTATGAAGAT

ACAAAGGAATCTTATAAACTTGAGCATGTTAAAGGTTCAGTTCCAAATGGAAAGTCAGAGG

CAAAAGCAGTTAACCCATATTCAAGTGAAGGTGAGCATATAAGAGAAATTCCAGAGGGAAC

ATTATCTAAACGTATTTCAGAAGTAGGTGATTTAGCTCATAATAAATATAAAATTGAGTTA

ACTGTCAGTGGAAAAACCATAGTAAAACCAGTGGACAAACAAAAGCCGTTAGATGTTGTCT

TCGTACTCGATAATTCTAACTCAATGAATAACGATGGCCCAAATTTTCAAAGGCATAATAA

AGCCAAGAAAGCTGCCGAAGCTCTTGGGACCGCAGTAAAAGATATTTTAGGAGCAAACAGT

GATAATAGGGTTGCATTAGTTACCTATGGTTCAGATATTTTTGATGGTAGGAGTGTAGATG

TCGTAAAAGGATTTAAAGAAGATGATAAATATTATGGCCTTCAAACTAAGTTCACAATTCA

GACAGAGAATTATAGTCATAAACAATTAACAAATAATGCTGAAGAGATTATAAAAAGGATT

CCTACAGAAGCTCCTAGAGCTAAATGGGGATCAACTACAAACGGACTTACTCCAGAGCAAC

AAAAGCAGTACTATCTTAGTAAAGTAGGGGAAACATTTACTATGAAAGCCTTCATGGAGGC
```

-continued

```
AGATGATATTTTGAGTCAAGTAGATCGAAATAGTCAAAAAATTATTGTTCATATAACTGAT

GGTGTTCCAACAAGATCATATGCTATTAATAATTTTAAATTGGGTGCATCATATGAAAGCC

AATTTGAACAAATGAAAAAAAATGGATATCTAAATAAAAGTAATTTTCTACTTACTGATAA

GCCCGAGGATATAAAAGGAAATGGGGAGAGTTACTTTTTGTTTCCCTTAGATAGTTATCAA

ACACAGATAATCTCTGGAAACTTACAAAAACTTCATTATTTAGATTTAAATCTTAATTACC

CTAAAGGTACAATTTATCGAAATGGACCAGTAAGAGAACATGGAACACCAACCAAACTTTA

TATAAATAGTTTAAAACAGAAAAATTATGACATCTTTAATTTTGGTATAGATATATCTGCT

TTTAGACAAGTTTATAATGAGGATTATAAGAAAAATCAAGATGGTACTTTTCAAAAATTGA

AAGAGGAAGCTTTTGAACTTTCAGATGGGGAAATAACAGAACTAATGAAGTCATTCTCTTC

TAAACCTGAGTATTATACCCCGATAGTAACTTCATCCGATGCATCTAACAATGAAATTTTA

TCTAAAATTCAGCAACAATTTGAAAAGGTTTTAACAAAAGAAAACTCAATTGTTAATGGAA

CTATAGAAGATCCTATGGGTGACAAAATCAATTTACAGCTTGGCAACGGACAAACATTGCA

ACCAAGTGATTATACTTTACAGGGAAATGATGGAAGTATAATGAAAGATAGCATTGCAACT

GGTGGGCCTAATAATGATGGTGGAATACTTAAAGGGGTTAAATTAGAATACATCAAAAATA

AACTCTACGTTAGAGGTTTGAACTTAGGGGAGGGACAAAAAGTAACACTCACATATGATGT

GAAACTAGATGACAGTTTTATAAGTAACAAATTCTATGACACTAATGGTAGAACAACATTG

AATCCTAAATCAGAGGATCCTAATACACTTAGAGATTTTCCAATCCCTAAAATTCGTGATG

TGAGAGAATATCCTACAATAACGATTAAAAACGAGAAGAAGTTAGGTGAAATTGAATTTAC

AAAAGTTGATAAAGATAATAATAAGTTGCTTCTCAAAGGAGCTACGTTTGAACTTCAAGAA

TTTAATGAAGATTATAAACTTTATTTACCAATAAAAAATAATAATTCAAAAGTAGTGACGG

GAGAAAACGGCAAAATTTCTTACAAAGATTTGAAAGATGGCAAATATCAGTTAATAGAAGC

AGTTTCGCCGAAGGATTATCAAAAAATTACTAATAAACCAATTTTAACTTTTGAAGTTGTT

AAAGGATCGATACAAATATAATAGCTGTTAATAAACAGATTTCTGAATATCATGAGGAAG

GTGACAAGCATTTAATTACCAACACGCATATTCCACCAAAAGGAATTATTCCGATGACAGG

TGGGAAA
```

Construct 6: gbs2018p

SEQ ID NO: 12
```
GATACTAGTTCAGGAATATCGGCTTCAATTCCTCATAAGAAACAAGTTAATTTAGGGGCGG

TTACTCTGAAGAATTTGATTTCTAAATATCGTGGTAATGACAAAGCTATTGCTATACTTTT

AAGTAGAGTAAATGATTTTAATAGAGCATCACAGGATACACTTCCACAATTAATTAATAGT

ACTGAAGCAGAAATTAGAAATATTTTATATCAAGGACAAATTGGTAAGCTAAATAAACCAA

GTGTAACTACACATGCTAAAGTTAGTGATCAAGAACTAGGTAAGCAGTCAAGACGTTCTCA

AGATATCATTAAGTCATTAGGTTTCCTTTCATCAGACCAAAAAGATATTTTAGTTAAATCT

ATTAGCTCTTCAAAAGATTCGCAACTTATTCTTAAATTTGTAACTCAAGCCACGCAACTGA

ATAATGCTGAATCAACAAAAGCTAAGCAAATGGCTCAAAATGACGTGGCCTTAATAAAAAA

TATAAGCCCCGAAGTCTTAGAAGAATATAAAGAAAAAATTCAAAGAGCTAGCACTAAGAGT

CAAGTTGATGAGTTTGTAGCAGAAGCTAAAAAAGTTGTTAATTCCAATAAAGAAACGTTGG

TAAATCAGGCCAATGGTAAAAAGCAAGAAATTGCTAAGTTAGAAAATTTATCTAACGATGA

AATGTTGAGATATAATACTGCAATTGATAATGTAGTGAAACAGTATAATGAAGGTAAGCTC

AATATTACTGCTGCAATGAATGCTTTAAATAGTATTAAGCAAGCAGCACAGGAAGTTGCCC

AGAAAAACTTACAAAAGCAGTATGCTAAAAAAATTGAAAGAATAAGTTCAAAAGGATTAGC

GTTATCTAAAAAGGCTAAAGAAATTTATGAAAAGCATAAAAGTATTTTGCCTACACCTGGA
```

-continued

```
TATTATGCAGACTCTGTGGGAACTTATTTGAATAGGTTTAGAGATAAACAAACTTTCGGAA

ATAGGAGTGTTTGGACTGGTCAAAGTGGACTTGATGAAGCAAAAAAAATGCTTGATGAAGT

CAAAAAGCTTTTAAAAGAACTTCAAGACCTTACCAGAGGTACTAAAGAAGATAAAAAACCA

GACGTTAAGCCAGAAGCCAAACCAGAGGCCAAACCAAATATTCAAGTACCTAAACAAGCAC

CTACAGAAGCTGCAAAACCAGCTTTGTCACCAGAAGCCTTGACAAGATTGACTACATGGTA

TAATCAAGCTAAAGATCTGCTTAAAGATGATCAAGTAAAGGACAAATACGTAGATATACTT

GCAGTTCAAAAAGCTGTTGACCAAGCTTATGATCATGTGGAAGAGGGAAAATTTATTACCA

CTGATCAAGCAAATCAATTAGCTAACAAGCTACGTGATGCTTTACAAAGTTTAGAATTAAA

AGATAAAAAAGTAGCCAAACCAGAAGCCAAACCAGAGGCCAAACCAGAAGCTAAGCCAGAA

GCTAAGCCAGAAGCTAAGCCAGAAGCTAAGCCAGAGGCCAAACCAGAAGCTAAGCCAGACG

TTAAGCCAGAAGCTAAACCAGACGTTAAACCAGAGGCTAAGCCAGAAGCTAAACCAGAGGC

TAAGTCAGAAGCTAAACCAGAGGCTAAGCTAGAAGCTAAACCAGAGGCCAAACCAGCAACC

AAAAAATCGGTTAATACTAGCGGAAACTTGGCGGCTAAAAAAGCTATTGAAAACAAAAAGT

ATAGTAAAAAATTACCATCAACG
```

Expression and purification of proteins: *E. coli* BL21 star® cells harboring the recombinant plasmid were grown into log phase in the required culture volume. Once an $OD_{600\,nm}$ of 0.6 was reached the culture was induced with 0.5 mM IPTG for 3 hours at 37° C. The cells were harvested by centrifugation, lysed by a combination of the freeze-thaw method followed by disruption of cells with 'Bug-buster®', (Novagen). The lysate was separated by centrifugation into soluble (supernatant) and insoluble (pellet) fractions. Depending on the location of the protein different purification strategies were applied. A) If the His-tagged protein was in the soluble fraction, protein purification was done by binding the supernatant to Ni-Sepharose beads (Ni-Sepharose™ 6 Fast Flow, GE Healthcare). Due to the presence of the hexa Histidine (6×HIS) at the C terminus of the expressed protein, it bound to the Ni-Sepharose while the other contaminating proteins were washed from the column by wash buffer. The protein was eluted by 500 mM Imidazole in 20 mM $NaH_2PO_4$, 0.5 mM NaCl buffer at pH 7.4. The eluate was concentrated, assayed by Bradford for protein concentration and checked by SDS-PAGE and Western blot. B) If the protein was present in the insoluble fraction, the pellet was solubilized in suitable buffer containing 8 M urea and applied onto the Ni-NTA column under denaturing conditions (in buffer containing 8 M urea) using the same materials and procedure as mentioned above. Contaminating proteins were washed from the column by wash buffer without urea. Refolding of the His-tagged protein was performed while the protein was immobilized on the Ni-NTA matrix. After renaturation, proteins were eluted by the addition of 500 mM Imidazole. The eluate was dialyzed to remove traces of urea and concentrated if the volume was large, checked by SDS-PAGE and measured by the Bradford method.

Animal Protection Studies

Animals: CD-1 Female Mice (6-8 weeks) were Used for These studies.

Active immunization, generation of hyper-immune mouse sera: 50 µg of recombinant protein was injected subcutaneously into CD-1 mice, adjuvanted with Complete Freund's adjuvant (CFA). Animals were boosted twice with the same amount of protein and Incomplete Freund's adjuvant (IFA) at days 14 and 28. The published protective Sip (gbs0031) protein antigen (Brodeur et al., Infect Immun. 68(10):5610-5618 (2000)) was used as a positive control, while mice immunized with adjuvant only served as negative controls. Antibody titres were measured at day 35 by ELISA using the respective recombinant proteins. In case of hyper-immune sera generation mice were terminally bled at day 35.

Generation of hyperimmune rabbit sera: Polyclonal rabbit sera were generated for gbs0031, gbs0233p, gbs1087p, gbs1309p, gbs1477p, gbs1478p and gbs2018p at Charles River Laboratories, Kislegg, Germany. 250 µg of recombinant protein was injected into New Zealand White rabbits, adjuvanted with Complete Freund's adjuvant (CFA). Animals were boosted three times with the same amount of protein, but with Incomplete Freund's adjuvant (IFA) at days 28, 42 and 56. Antibody titers were measured at day 38 and 52 by ELISA using the respective recombinant proteins. Rabbits were terminally bled at day 70.

Passive immunization: CD-1 mice were immunized intraperitoneally 1 to 3 hours before the bacterial challenge with 150 µl mouse or rabbit hyperimmune sera.

Bacterial challenge: Freshly grown *S. agalactiae* strains C388/90 (serotype Ia/c), A909 (serotype Ia/c), ATCC12401 (serotype Ib), ATCC12403 (serotype III), COH1 (serotype III), BAA22 (serotype III), 2603V/R (serotype V), ATCC49447 (serotype V), BAA23 (serotype V) were used for animal challenge studies. In order to determine the viable cell numbers present in the bacterial inoculum, cfus were determined via plating on blood agar plates. $10^6$-$10^8$ cfus were applied intraperitoneally into mice. Protection by immunization was measured by a lethal sepsis model, where survival rates were followed for 1 to 2 weeks post-challenge and survival was expressed as percentage of the total number of animals (10 mice/group).

Results

By using a genomic scale antigen identification method we selected Group B streptococcal antigens based on immunogenicity in humans (WO2004/099242) and pre-selected vaccine candidates based on in vitro assays. Here we show immune protection by six Group B streptococcal antigens in animal models. The first screening model was set up using adult mice and the mouse-adapted *S. agalactiae* ATCC12403 serotype III strain that was also used for the genomic library construction and cloning of some of the vaccine candidates. We set up the method with CD-1 mice and defined the $LD_{90}$-$L13_{100}$ dose. The model set up was further optimized by using positive and negative control sera. Protection was estimated by reduced lethality of mice immunized with Sip or anti-Sip immune sera relative to animals immunized with adjuvant alone or treated with control sera. Based on these data, CD-1 mice and a challenge dose between $5 \times 10^7$ to $1 \times 10^8$ cfu was used for further studies. Mice were immunized first with the recombinant antigens adjuvanted with CFA/IFA and in subsequent experiments with hyper-immune mouse sera transferred to naïve animals before challenge with S. agalactiae ATCC12403 (serotype III). In the active, as well as in the passive model, several protective antigens were identified that showed variable protection levels, ranging from higher, equal or lower survival relative to Sip. Since several different Group B Streptococcus serotypes are able to cause severe disease in humans, it is important to test cross-protection of vaccine candidates against all major serotypes in animal experiments. Moreover, it has been firmly demonstrated that protective antigens show strain-dependent variations not only in their primary sequences and expression, but also in their protective capacity. For that reason, we have set up the screening model with several different S. agalactiae strains representing the major serotypes, Ia, Ib, III and V. Strain-dependent protection within one serotype was also addressed by using 2-3 different strains of the most common serotypes Ia, III and V. In order to perform this large number of experiments with the minimal animal sacrifice and good comparability, we generated hyper-immune rabbit sera for all in vitro selected recombinant antigens. Three rabbits were immunized with each individual antigen adjuvanted with CFA/IFA using a standard protocol. Animals were pre-screened for pre-existing GBS-specific antibodies by testing their sera with ELISA and only animals without a significant reaction were included in immunization studies. The individual hyper-immune sera were then analyzed for antigen-specific antibody levels and used in pools for further analyses. Thus, the very same immune sera were used for passive protection studies with nine different GBS strains that we found useful for animal studies. As a result of these experiments we could identify six novel vaccine candidates—gbs0233p, gbs1087p, gbs1309p, gbs1477p, gbs1478p and gbs2018p—that showed protection against at least one serotype when used as a sole antigen (FIG. 1).

Figure 2:
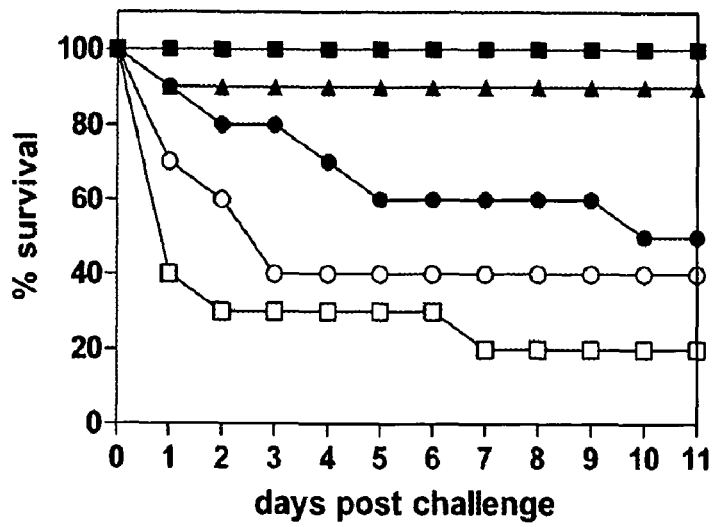
FIG. 2 shows the protection achieved with a combination of *S. agalactiae* antigen-specific hyperimmune rabbit sera in a mouse lethality model. CD-1 mice (10 mice per group) were immunized intraperitoneally with different combinations of hyperimmune rabbit sera (150 µl per hyper-immune rabbit sera) 1-3 hours before an intraperitoneal challenge. Sip- and PBS-induced sera were used as positive and negative controls, respectively. Mice were immunized with combinations of sera induced by gbs1087p, gbs1477p, gbs1478p and gbs2018p; challenge with (A) $5\times10^6$ cfu ATCC12401 (serotype Ib); (B) $1\times10^8$ cfu ATCC12403 (serotype III) and (C) $1\times10^8$ cfu ATCC49447 (serotype V). Survival was monitored for 11 days post-challenge. Numbers of surviving mice are plotted as percentage of total mice.

In order to examine benefits of combinations of different antigenic components, we performed passive protection studies by combining rabbit sera with different antigen specificities. With different combinations using these six protective vaccine candidates, we could demonstrate increased protection compared to the single proteins against all the tested GBS serotypes. The combination of gbs1477p+gbs2018p provided a significantly increased level of protection against many serotypes. The best protection seen so far was achieved with a combination of gbs1087p+gbs1477p+gbs1478p+gbs2018p that protected most of the mice against all nine tested GBS strains (FIG. 2).

Example 2

Surface Exposure and Induction of Functional Antibodies by Group B Streptococcal Antigens Experimental Procedures
FACS Analysis:
The S. agalactiae strain to be tested was inoculated from a glycerol stock into 5 ml THB medium and incubated overnight at 37° C. The overnight culture was reinoculated by adding 200 µl into 10 ml fresh THB medium and incubated until an $OD_{600\ nm}$ of approximately 1 was reached (~$5 \times 10^8$ cells/ml). The bacterial cells were pelleted by centrifugation at 4,000 rpm for 5 min and washed twice with 2 ml HBSS. The final pellet was resuspended in HBSS with 1% BSA to give a cell density of $5 \times 10^6$ cells/ml. To 100 µl bacterial suspension 1 µl serum was added and incubated for 45 min on ice. Bacteria were pelleted by centrifugation at 1,000 g for 4 min and washed once with 150 µl HBSS with 1% BSA and resuspended in 100 µl HBSS with 1% BSA. To the opsonised bacteria 1 µl of the secondary antibody (goat F(ab)2 fragment anti rabbit IgG coupled with PE) was added and incubated for 45 min on ice in the dark. The cells were washed twice with 150 µl HBSS as described above and dissolved in 250 µl HBSS, the cells were fixed by the addition of 250 µl 4% para-formaldehyde. The fluorescent staining of the bacteria was measured by FACS analysis.

Opsonophagocytic Killing Assay
Preparation of bacterial cells: The S. agalactiae strain to be tested was inoculated from a glycerol stock into 5 ml THB medium and incubated overnight at 37° C. The over night culture was reinoculated by adding 200 µl into 10 ml fresh THB medium and incubated until an $OD_{600\ nm}$ of approximately 1 was reached. The bacteria were pelleted by centrifugation at 4,000 rpm for 5 min and washed twice with 2 ml HBSS. The final pellet was resuspended in HBSS with 0.125% BSA to give a final concentration of $5 \times 10^4$ cells/85 µl.

Preparation of RAW264.7 cells: Cells were cultivated in T175 flasks with 25 ml DMEM high glucose medium at 37° C. with 5% $CO_2$. Cells were detached from the flasks by scraping and collected by low speed centrifugation at 1,000 rpm for 10 min and washed twice with 50 ml HBSS with 10 mM glucose and resuspended in HBSS with 10 mM glucose to give a cell concentration of $1 \times 10^7$ cells/ml.

Opsonophagocytic killing assay: Bacteria (85 µl) were mixed with 10 µl guinea pig complement and 5 µl prediluted serum and incubated for 60 min at 6° C. with shaking (500 rpm). To the opsonised bacteria 100 µl ($1 \times 10^6$ cells) RAW264.7 cells were added. Three aliquots of 10 µl were taken and each added to 1.5 ml water after 5 min incubation, 100 µl were plated on blood agar plates to determine the initial bacterial count, $T_0$. The suspensions with opsonised bacteria and RAW264.7 cells were incubated for one hour at 37° C. with shaking (500 rpm). After 60 min incubation three aliquots of 10 µl were removed and each diluted in 1.5 ml, after 5 min incubation, 100 µl were plated on blood agar plates to determine $T_{60}$. After overnight cultivation cfus were determined with a colony counter.

Evaluation: For each sample the relationship between the cfu at $T_0$ and $T_{60}$ was determined. The percentage killing of each test serum was related to the respective preimmune serum using the relationship between $T_0$ and $T_{60}$ with the formula 100-100×(test scrum/preimmune scrum).

Figure 3:
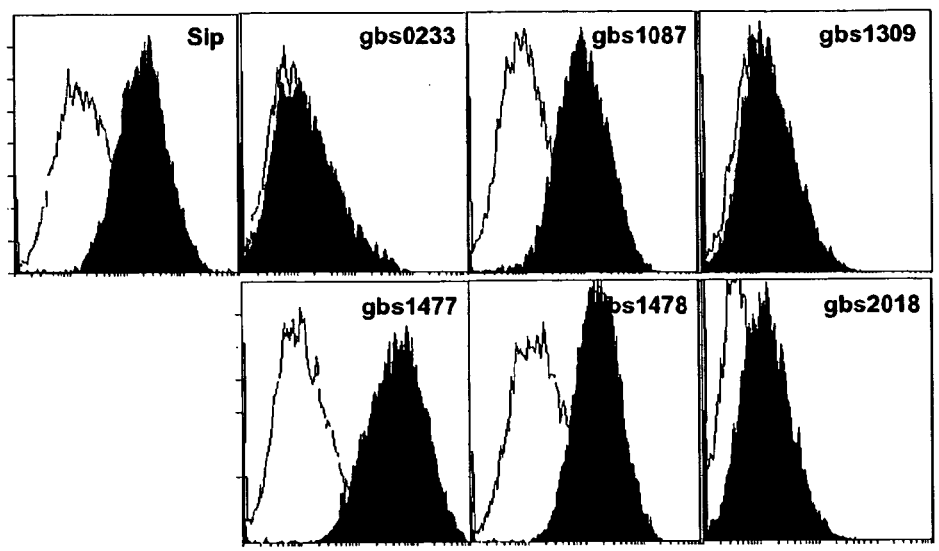
FIG. 3 shows the surface staining of the serotype III GBS strain ATCC12403. The results for the hyperimmune rabbit sera (black) are shown in comparison to those for the respective preimmune sera (white).

Results
The analyses of surface expression of gbs0233, gbs1087, gbs1309, gbs1477, gbs1478 and gbs2018 have been performed by FACS analysis using the very same pooled rabbit hyperimmune sera that were tested for protection in animal studies. These six protective antigens were detected on the surface of Group B streptococcal strains. Four of the antigens (gbs1087, gbs1477, gbs1478, gbs2018) were most consistently detected (FIG. 3), gbs0233 was not expressed in vitro by all strains and gbs1309 was mainly detected in the bacterial supernatant. The in vitro expression experiments have been performed with nine different strains from the serotypes Ia, Ib, II, III, IV and V; the most comprehensive studies have been performed with the serotype III strain ATCC12403.

Figure 4:
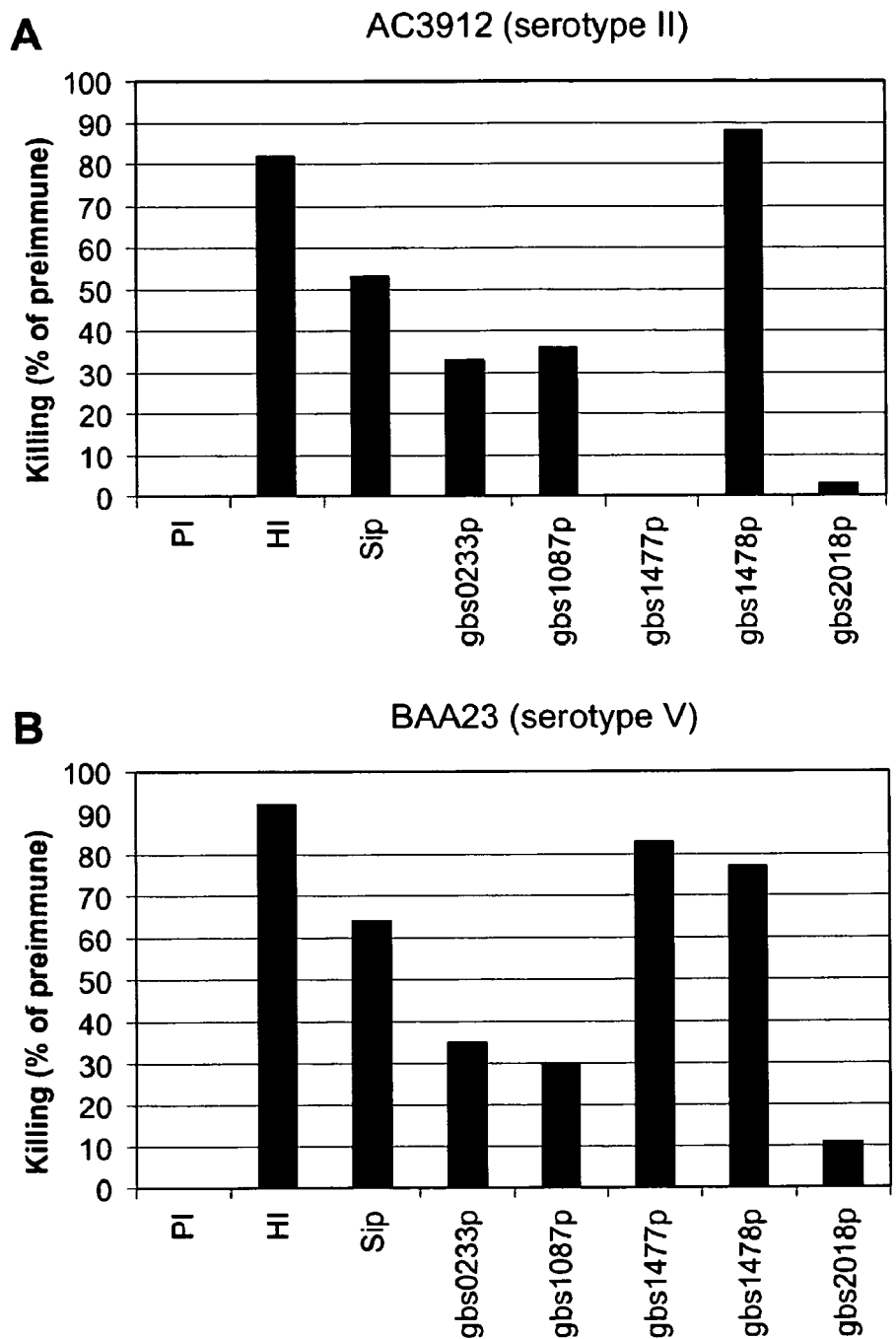
FIG. 4 shows an opsonophagocytic killing assay with hyperimmune rabbit sera and different GBS strains. (A) Serotype II GBS strain AC3912, not suitable for animal testing. (B) Serotype V GBS strain BAA23, used for animal testing. PI, preimmune sera; HI, hyperimmune sera. GBS cells in the exponential phase were opsonised with 200-fold diluted sera in the presence of 5% guinea pig complement for 60 minutes. Phagocytic cells (RAW264.7) were added to opsonised bacteria and incubated for an additional 60 minutes at 37° C. Surviving bacteria were counted on agar plates after overnight incubation at 37° C. Percentage of killing was calculated based on CFU obtained after incubation with the different hyperimmune sera relative to CFU obtained with preimmune sera at 0 min and after 60 min of incubation as described under experimental procedure.

Based on the passive protection data, it is firmly established that protection by the selected six vaccine candidates is mainly mediated by antibodies. The ability to measure functional antibodies in in vitro assays is essential for the development of both a prophylactic vaccine and an antibody-based therapy or prevention. Nine different *S. agalactiae* strains representing six serotypes (Ia, Ib, II, III, IV and V) were used to evaluate gbs0233p, gbs1087p, gbs1309p, gbs1477p, gbs1478p and gbs2018p for induction of functional antibodies. Included in the opsonophagocytic killing assays were two GBS strains representing serotypes II and IV that were not suitable for animal testing. As an example of the in vitro assays, results with two strains are presented in FIG. 4, the serotype II strain AC3912 (FIG. 4A) and the serotype V strain BAA23 (FIG. 4B). Simultaneously with the opsonophagocytic killing assay cells were tested for in vitro expression of the tested antigens by Western blot and FACS analysis. At a serum dilution of 1:200, only gbs1478p showed more than 50% killing of the serotype II strain AC3912 (FIG. 4A), both gbs1477p and gbs1478p showed more than 50% killing of the serotype V strain BAA23 (FIG. 4B). The remaining antigens showed less than 50% killing of the strains tested in FIG. 4, which in most cases can be explained by poor in vitro expression of the antigens in these strains.

Example 3

Sequence Conservation of Protective Group B Streptococcal Antigens

Experimental Procedures

Sequence analyses of *S. agalactiae* genes: In order to determine the sequence of an antigen from diverse *S. agalactiae* strains, PCR was performed with primers specific for the gene of interest. *S. agalactiae* strains used for these analyses are shown in Tables 2 and 13. Oligonucleotide sequences as primers for PCR were designed for the selected antigens in order to be able to amplify the full gene. Sequencing was performed with dedicated primers using the PCR products as templates. The sequences of the oligonucleotides are listed in Table 3. Genomic DNA of all *S. agalactiae* strains was prepared as described in WO2004/099242. PCR was performed in a reaction volume of 25 µl using Taq polymerase (1 U), 200 nM dNTPs, 10 pMol of each oligonucleotide and the kit according to the manufacturer's instructions (Invitrogen, The Netherlands). As standard, 30 cycles (1×: 5 min. 95° C., 30×: 30 sec. 95° C., 30 sec. 56° C., 30 sec. 72° C., 1×: 4 min. 72° C.) were performed, unless conditions had to be adapted for individual primer pairs. PCR samples were sequenced with the oligonucleotides as listed in Table 3.

Results

The genomic sequence of eight individual strains of *S. agalactiae* (Tables 2 and 4) has been published and was compared for the six antigens shown to be protective under Example 1. The comparison showed that the proteins gbs0233 and gbs1087 are highly conserved (more than 99 and 91% identity, respectively; Tables 2 and 4), although gbs1087 displayed various numbers of repeats in the different GBS strains (see also WO2004/035618). This high degree of protein sequence identity (gbs0233: >99%; gbs1087: >86%) could also be observed for the strains that were subjected to DNA sequence analyses as listed in Tables 5, 7, 8, and Table 13 and in the Sequence listing. The gbs0233 protein from any of the analyzed strains showed at least 98.7% amino acid sequence identity to gbs0233 from *S. agalactiae* NEM316, with only 6 amino acid position showing a change. The sequences of the gbs1087 proteins from the analyzed strains were also highly conserved, yet the different strains harboured between a single and up to 29 repeats of a highly conserved 17 amino acid long sequence. The sequences of proteins gbs1309 and gbs2018 showed high sequence conservation in 7 genomic strains (more than 87 and 77% identity, respectively), while protein sequences diverged more significantly in strain COH1 (69.9 and 47.7%, respectively; Table 4). The gbs1309 protein showed a similar high degree of amino acid sequence identity (89.6%) in the sequenced GBS strains (Table 5, 9, 13 and. Sequence listing), while the gbs2018 protein can be classified in two clades, with 95% of strains belonging to one clade with at least 60.8% sequence identity and 3 strains COH1(III), BAA22(III) and 49447(V) belonging to the second clade. The protein gbs1478 is highly conserved in 6 genomic strains (more than 87% identity), yet the strains COH1 and A909 show a lower amino acid sequence identity of approximately 43% (Table 4). Protein gbs1478 is conserved in most analyzed GBS strains as shown in Table 5, 11, 13 and the Sequence listing, but exists as 2 distinct clades with an amino acid sequence identity of more than 80% in the dominant clade (approx. 80% of analyzed strains) and more than 99% in the second clade. The protein gbs1477 shows the highest degree of amino acid sequence variability, with six distinct clades that can be characterized. Strains COH1 and A909 do not encode a homologous protein with significant amino acid sequence identity (Table 4). The sequence analyses of the gbs1477 gene from further distinct GBS strains revealed that all selected strains encode a protein homologous to gbs1477 and that all six clades were covered by these sequences (Table 5, 6, 10, 13, Sequence listing and FIG. 5). The prototype sequences for the 6 clades of gbs1477 are: strain 12401 (clade 1; SEQ ID NO: 93), strain IC254 (clade 2; SEQ ID NO: 110), strain 126H4A (clade 3; SEQ ID NO: 94), strain 49447 (clack 4; SEQ ID NO: 95), strain C388/90 (clade 5; SEQ ID NO: 100) and strain NEM316 (clade 6; SEQ ID NO: 223 and SEQ ID NO: 361); (for all sequences, see Sequence listing). Within any single clade the level of amino acid sequence identity reaches at least 98%.

Example 4

Group B Streptococcal Antigens and Combinations Thereof as well as Mouse Monoclonal Antibodies, Generated Against these Antigens, Induce Protective Immune Responses Against Lethal Sepsis in an i.p. Challenge Model Experimental Procedures
Cloning and Expression of Recombinant Group B Streptococcal Proteins Cloning of genes: The gene of interest was amplified from genomic DNA of *S. agalactiae* ATCC12403 (serotype III) by PCR using gene specific primers. Apart from the gene specific part, the primers had restriction sites that aided in a directional cloning of the amplified PCR product. The gene annealing (specific) part of the primer ranged between 15-30 bases in length. The PCR products obtained were digested with the appropriate restriction enzymes and cloned into the pET28b (+) vector (Novagen) for His-tagged proteins. Once the recombinant plasmid was confirmed to contain the gene of interest, *E. coli* BL21 star® cells (Invitrogen) that served as expression host were transformed. Cloning of the gbs1087, gbs1477 and gbs1478 genes has been performed using genomic DNA from strain *S. agalactiae* 6313 (serotype III) in the vector pET28a (+). The constructs of the selected antigens are listed in Table 1.

Expression and Purification of Proteins:

*E coli* BL21 star® cells harboring the recombinant plasmid were grown into log phase in the required culture volume. Once an $OD_{600\,nm}$ of 0.6 was reached the culture was induced with 0.5 mM IPTG for 3 hours at 37° C. The cells were harvested by centrifugation, lysed by a combination of the freeze-thaw method followed by disruption of cells with 'Bug-buster®' (Novagen). The lysate was separated by centrifugation into soluble (supernatant) and insoluble (pellet) fractions. Depending on the location of the protein different purification strategies were applied. A) If the His-tagged protein was in the soluble fraction, protein purification was done by binding the supernatant to Ni-Sepharose beads (Ni-Sepharose™ 6 Fast Flow, GE Healthcare). Due to the presence of the hexa Histidine (6×HIS) at the C terminus of the expressed protein, it bound to the Ni-Sepharose while the other contaminating proteins were washed from the column by wash buffer. The protein was eluted by 500 mM Imidazole in 20 mM $NaH_2PO_4$, 0.5 mM NaCl buffer at pH 7.4. The eluate was concentrated, assayed by Bradford for protein concentration and checked by SDS-PAGE and Western blot. B) If the protein was present in the insoluble fraction, the pellet was solubilized in suitable buffer containing 8 M Urea and applied onto the Ni-NTA column under denaturing conditions (in buffer containing 8 M Urea) using the same materials and procedure as mentioned above. Contaminating proteins were washed from the column by wash buffer without urea. Refolding of the His-tagged protein was performed while the protein was immobilized on the Ni-NTA matrix. After renaturation, proteins were eluted by the addition of 500 mM Imidazole. The eluate was dialyzed to remove traces of urea and concentrated if the volume was large, checked by SDS-PAGE and measured by the Bradford method.

Animal Protection Studies

Animals: CD-1 Female Mice (6-8 Weeks) were used for these Studies.

Active immunization: 25 µg of recombinant protein was injected subcutaneously into CD-1 mice, adjuvanted with ALUM 1%. Animals were boosted twice with the same amount of protein and ALUM 1% at days 14 and 28. The published protective Sip (gbs0031) protein antigen was used as a positive control, while mice immunized with adjuvant only served as negative controls. Antibody titres were measured at day 35 by ELISA using the respective recombinant proteins.

Generation of hyperimmune rabbit sera: Polyclonal rabbit sera were generated for gbs0031, gbs0233p, gbs1087p, gbs1309p, gbs1477p, gbs1478p and gbs2018p at Charles River Laboratories, Kislegg, Germany. 250 µg of recombinant protein was injected into New Zealand White rabbits, adjuvanted with Complete Freund adjuvant (CFA). Animals were boosted three times with the same amount of protein, but with Incomplete Freund adjuvant (IFA) at days 28, 42 and 56. Antibody titers were measured at day 38 and 52 by ELISA using the respective recombinant proteins. Rabbits were terminally bled at day 70.

Generation of mouse monoclonal antibodies: Monoclonal mouse antibodies were generated against gbs0233p, gbs1087p, gbs1477p, gbs1478p and gbs2018p at Abgent, San Diego, USA. 100 µg of recombinant protein was injected into Balb/c mice, adjuvanted with Complete Freund adjuvant (CFA). Animals were boosted with 50 µg protein and CFA at week 2; at week 3 animals were boosted with the same amount of protein, but with Incomplete Freund adjuvant (IFA) and at week 4 and 5 animals were boosted with 50 µg protein in PBS (without adjuvant). Antibody titers were measured in week 5 by ELISA and Western blotting using the respective recombinant proteins. Spleen cells from mouse with the best titer were fused with myeloma cell F0 using PEG protocol. Subsequently growing fused hybridoma clones were screened against the respective antigen for test of their specificity and sensitivity. ELISA positive clones were tested also by Western blot. Selected clones from this test were subcloned at least two times and antibodies were purified by protein G affinity chromatography from culture medium.

Passive immunization (neonates): Pregnant CD-1 mice were given 0.5 ml undiluted rabbit hyper-immune sera by intraperitoneal injection 2 to 4 days before delivery. Within 48 h after birth, pups were challenged intraperitoneally.

Bacterial challenge: Freshly grown *S. agulactiae* strains C388/90 (serotype Ia/c), A909 (serotype Ia/c), ATCC12401 (serotype Ib), ATCC12403 (serotype III), COH1 (serotype III), ATCCBAA22 (serotype III), 2603V/R (serotype V), ATCC49447 (serotype V), ATCCBAA23 (serotype V) were used for animal challenge studies. In order to determine the viable cell numbers present in the bacterial inoculum, cfus were determined via plating on blood agar plates. $10^6$-$10^8$ cfus were applied intraperitoneally into mice. Protection by immunization was measured by a lethal sepsis model, where survival rates were followed for 1 to 2 weeks post-challenge and survival was expressed as percentage of the total number of animals (10 mice/group for active immunization; for neonatal challenge number of animals depends on the litter size).

Results

Figure 6:
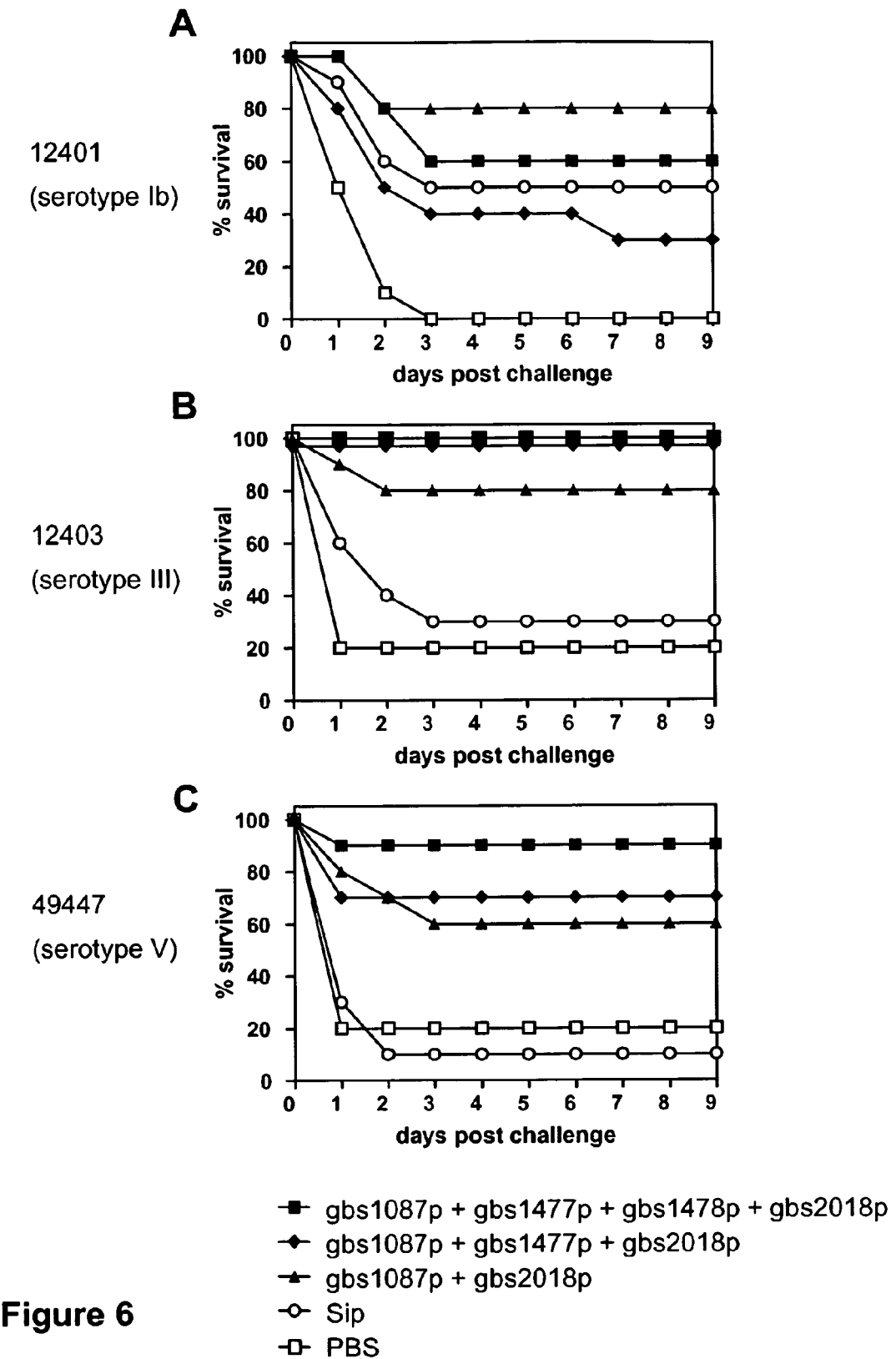
FIG. 6 shows active protection of adult mice by immunizing with a combination of GBS antigens. CD-1 mice (10 mice per group) were immunized with different combinations of the recombinant proteins (gbs1087p, gbs1477p, gbs1478p and gbs2018p; 25 µg each). As positive control 25 µg Sip protein (open circle) was used. For the negative control, PBS (open square) was used with ALUM 1%. One week after the last booster immunization, mice were challenged with (A) $3.5\times10^6$ cfu 12401; (B) $8.8\times10^7$ cfu 12403 or with (C) $1.1\times10^8$ cfu 49447. Numbers of surviving mice are plotted as a percentage of the total number of mice.
Figure 7:
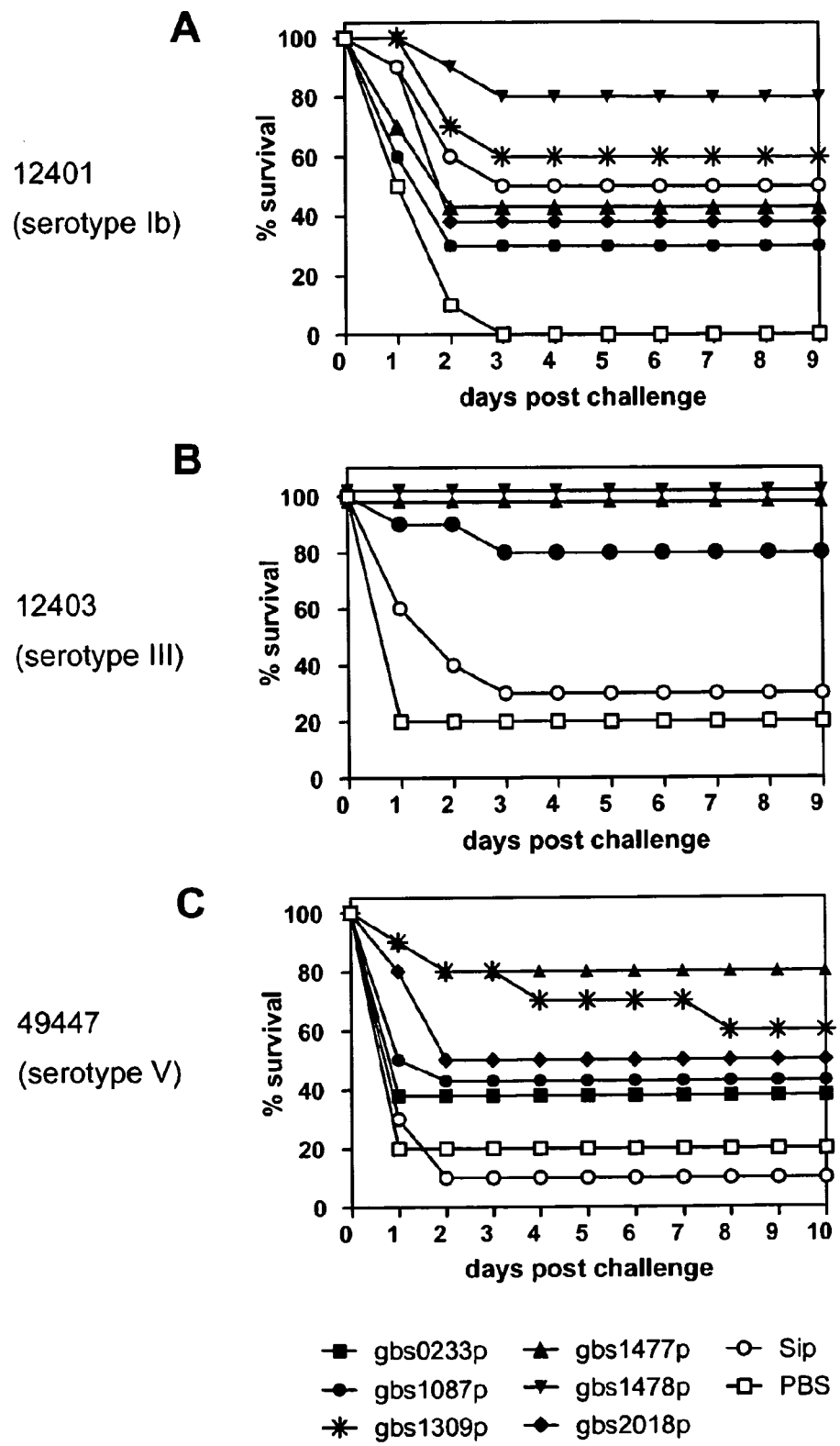
FIG. 7 shows active protection of adult mice by immunizing with single GBS antigens. CD-1 mice (10 mice per group) were immunized with different recombinant proteins (gbs0233p, gbs1087p, gbs1309p, gbs1477p, gbs1478p and gbs2018p; 50 µg each). As positive control 50 µg is Sip protein (open circle) was used. For the negative control, PBS (open square) was used with ALUM 1%. One week after the last booster immunization, mice were challenged with (A) $3.5\times10^6$ cfu 12401; (B) $8.8\times10^7$ cfu 12403 or with (C) $1.1\times10^8$ cfu 49447. Numbers of surviving mice are plotted as a percentage of the total number of mice.

By using a genomic scale antigen identification method we selected Group B antigens based on immunogenicity in humans (WO04/099242) and pre-selected vaccine candidates based on in vitro assays. We have shown previously immune protection by six Group B streptococcal antigens in animal models. Additionally, with different combinations using these six protective vaccine candidates, we demonstrated increased protection compared to the single proteins against all the tested GBS serotypes. The combination of gbs1477p+gbs2018p provided a significantly increased level of protection against many serotypes. The best protection seen so far was achieved with a combination of gbs1087p+gbs1477p+gbs1478p+gbs2018p that protected most of the mice against all nine tested GBS strains (see Example 1 and FIG. 2). So far these experiments were obtained in serum transfer experiments. We now further substantiated these results by active immunization of mice with two, three or four recombinant proteins using ALUM as adjuvant (FIG. 6). Immunization with single proteins verified the data already obtained with the hyper-immune rabbit sera (FIG. 7).

Figure 8:
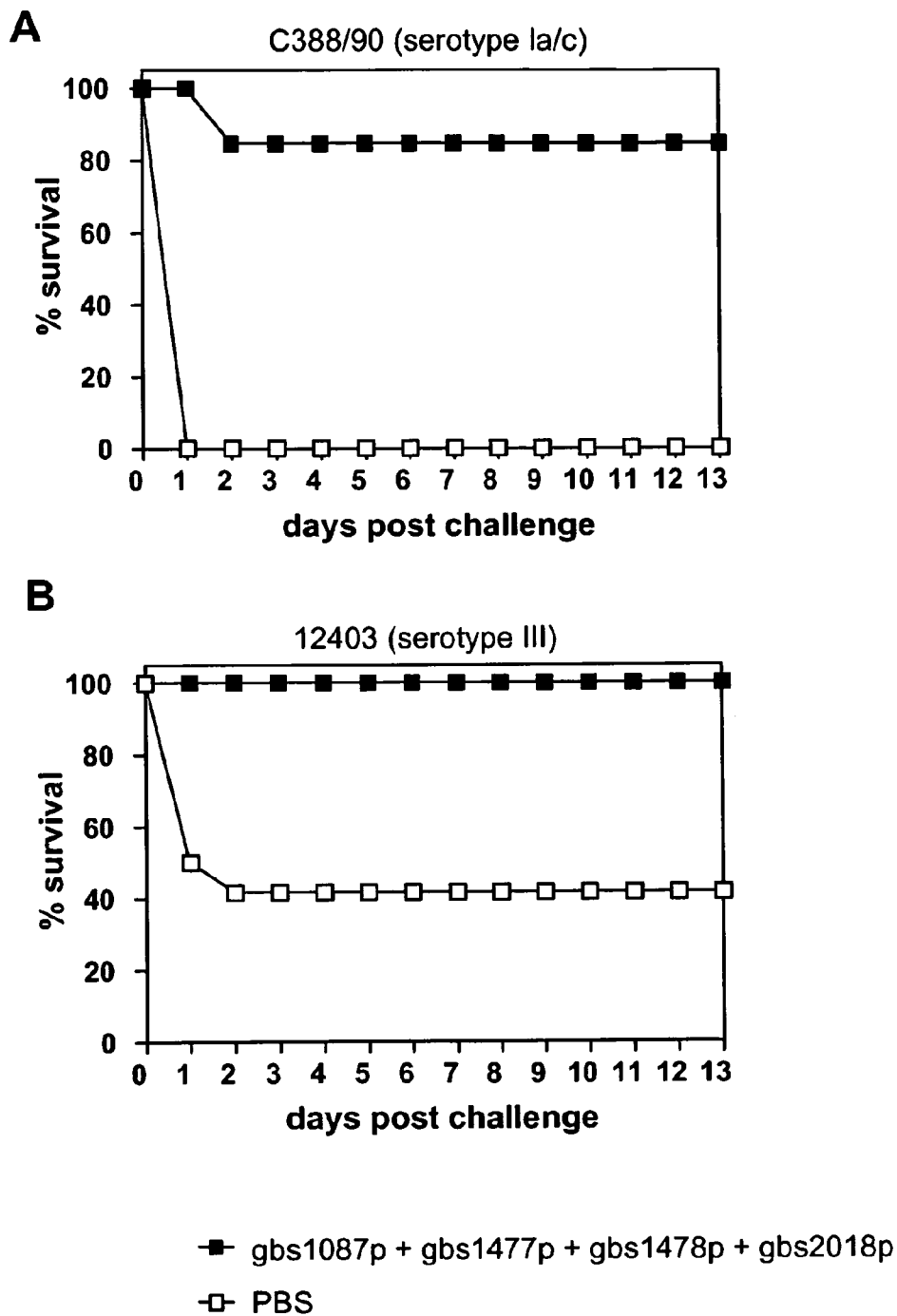
FIG. 8 shows the protection of neonatal mice by immunization of mothers passively with rabbit sera generated with a combination of recombinant GBS antigens. Pregnant CD-1 mice were immunized at day 18 post gestation with 500 µl of combinations of gbs1087p, gbs1477p, gbs1478p and gbs2018p-induced sera or PBS-induced control sera. Neonates were challenged within 24-38 hours after birth with lethal challenge doses of (A) $1.2\times10^7$ cfu C388/90; (B) $1.3\times10^6$ cfu 12403; (C) $5.7\times10^6$ cfu BAA23 or (ID) $1.8\times10^8$ cfu 2603V/R. Numbers of surviving neonates are plotted as a percentage of the total number of challenged neonates.
Figure 8:
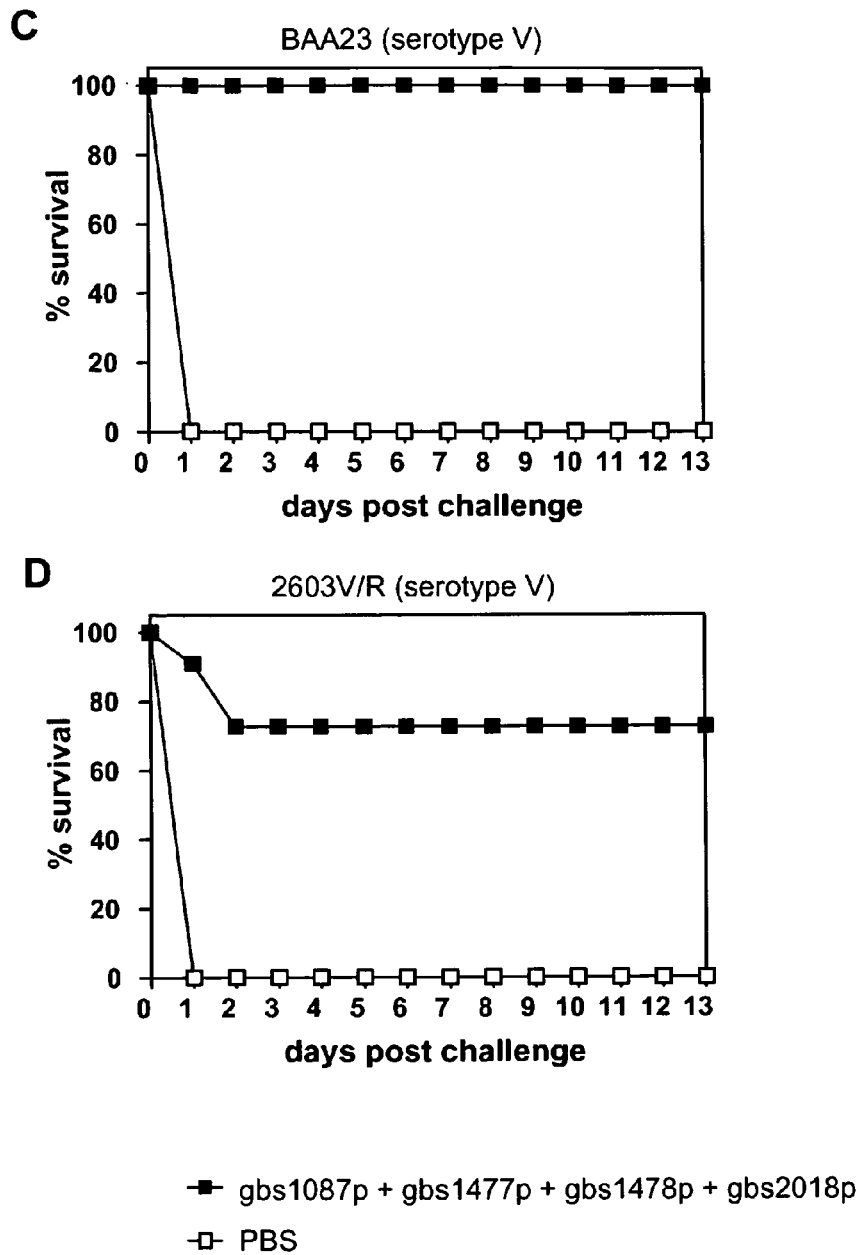

Since GBS sepsis affects mainly newborns, we have also developed a model that can demonstrate protection in neonatal mice. We established a murine model with passive immunization of pregnant mice with hyperimmune rabbit sera (500 µl i.p.) 2-4 days before delivery and challenging their babies with *S. agalactiae* 24-48 h after birth. We observed excellent protection of newborn mice born to mothers immunized with the combination of gbs1087p+gbs1477p+gbs1478p+gbs2018p specific immune sera (4×125 µl) (FIG. 8). Hyperimmune sera against the individuals antigens were also effective in this, but overall was lower than that obtained with the combination of four (data not shown). These findings are very significant, since the models with the different GBS strains were very stringent, resulting in death of infected pups within 24 hours.

Since the protein gbs1477 has the highest sequence variability and exists in different clades (Table 5 & 6, FIG. 5) the protection was analyzed using the adult sepsis/lethality model.

Figure 9:
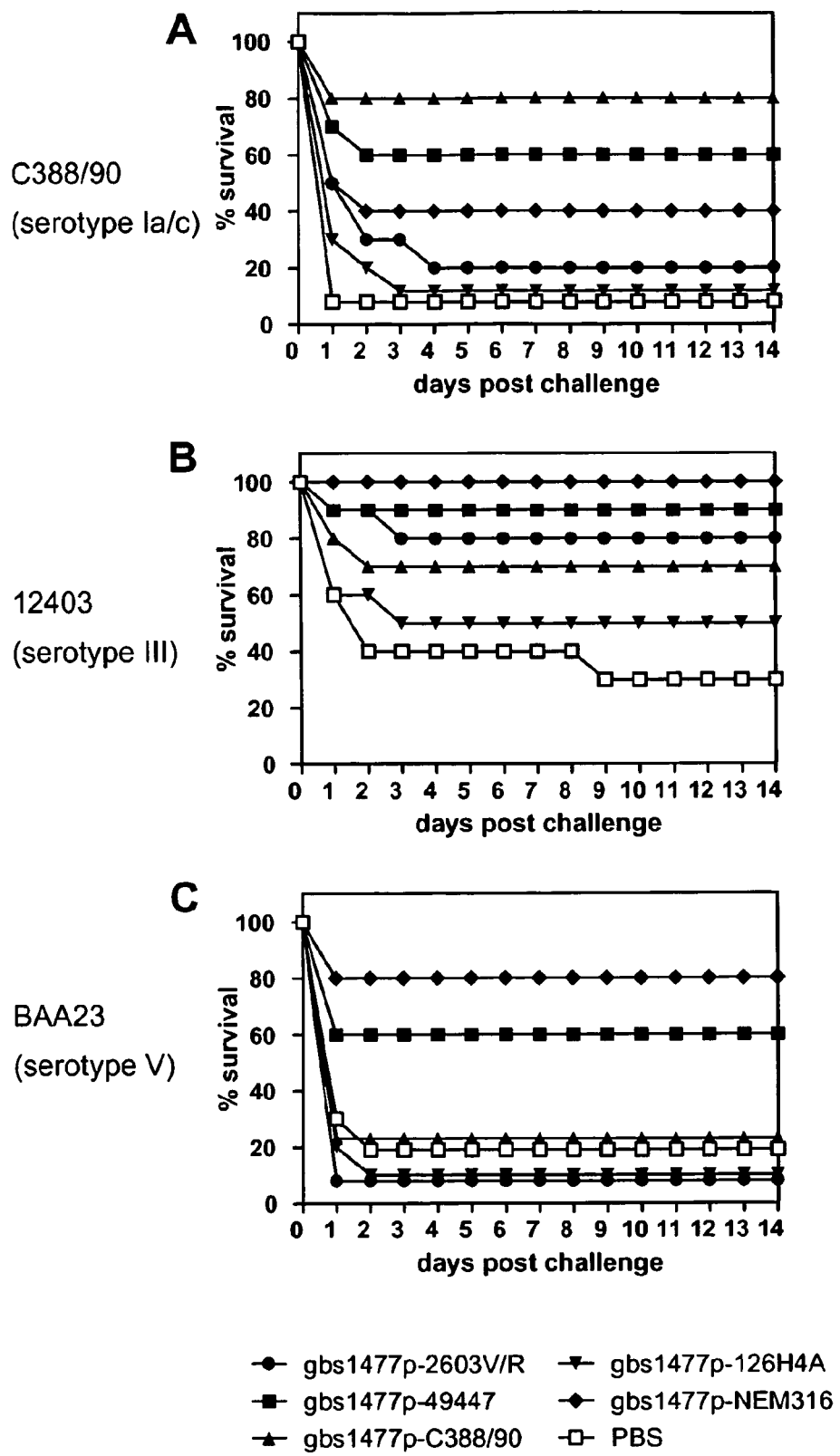
FIG. 9 shows active protection of adult mice by immunizing with different clade gbs1477p proteins. CD-1 mice (10 mice per group) were immunized with different clade proteins of gbs1477p (gbs1477p-2603V/R, gbs1477p-49447, gbs1477p-C388/90, gbs1477p-126H4A and gbs1477p-NEM316; 50 µg each). As negative control, PBS (open square) was used with ALUM 1%. One wcck after the last booster immunization, mice were challenged with (A) $1.4\times10^7$ cfu C388/90; (B) $1.2\times10^8$ cfu 12403 or with (C) $1.6\times10^8$ cfu BAA23. Numbers of surviving mice are plotted as a percentage of the total number of mice.

Mice were immunized with fragments (corresponding to gbs1477p of strain 6313) of six different gbs1477 proteins, originated from distinct clades. Protection was measured against the homologous as well as against the heterologous clade (FIG. 9). The best protection was always obtained when immunization and challenge is done with the homologous clade. The more variable the sequences of the different clades are the lower the protection obtained in the sepsis model.

Figure 10:
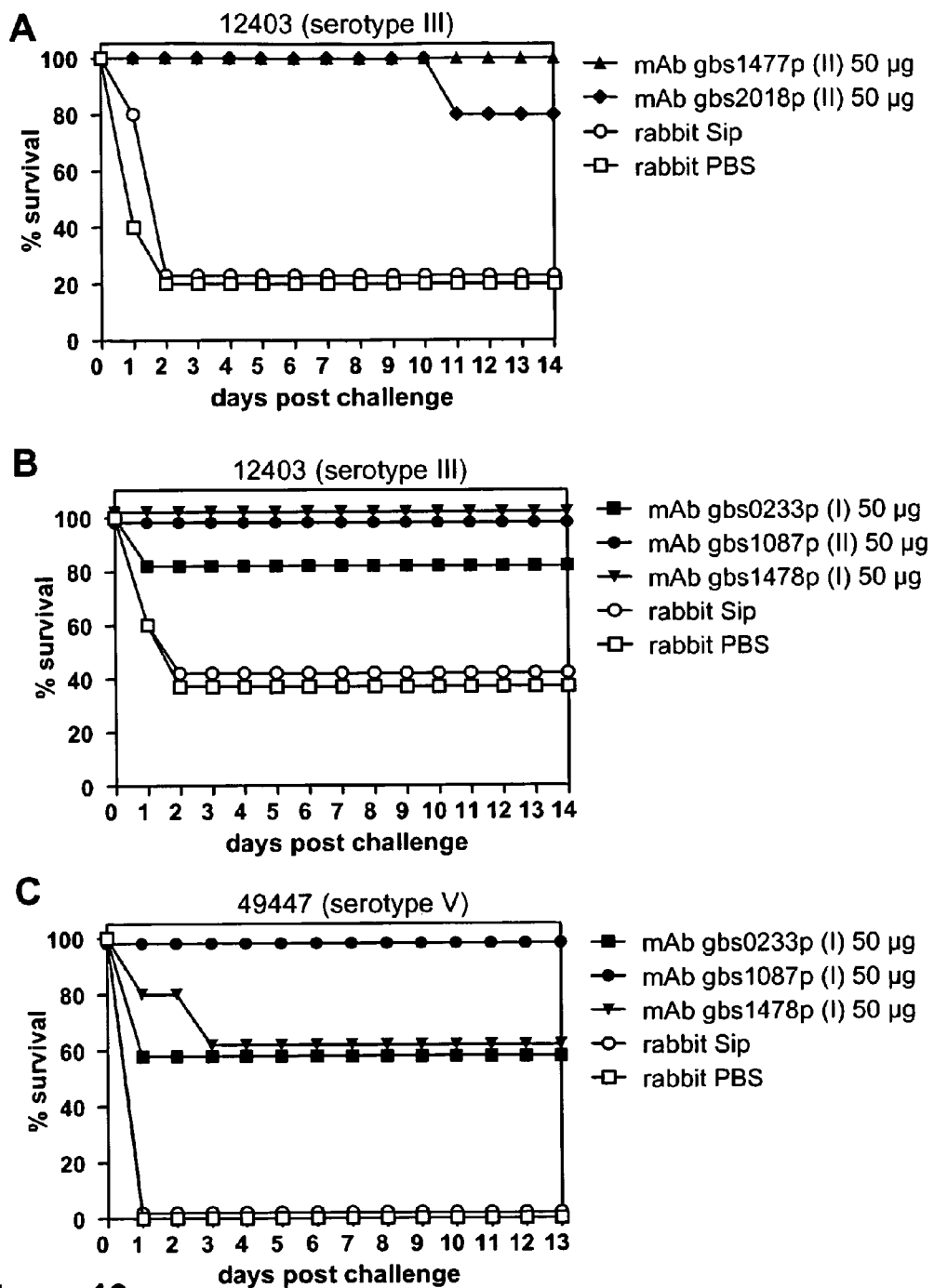
FIG. 10 shows the protection of adult mice by immunization with mouse mAbs against different recombinant GBS antigens. CD-1 mice were immunized intraperitoneally with 50 µg of the respective mouse mAb. 1 to 3 hours later, mice were challenged intraperitoneally with (A) $1.2\times10^8$ cfu 12403; (B) $1.5\times10^8$ cfu 12403 or (C) $1.1\times10^8$ cfu 49447. Numbers of surviving mice are plotted as a percentage of the total number of challenged mice.
Figure 11:
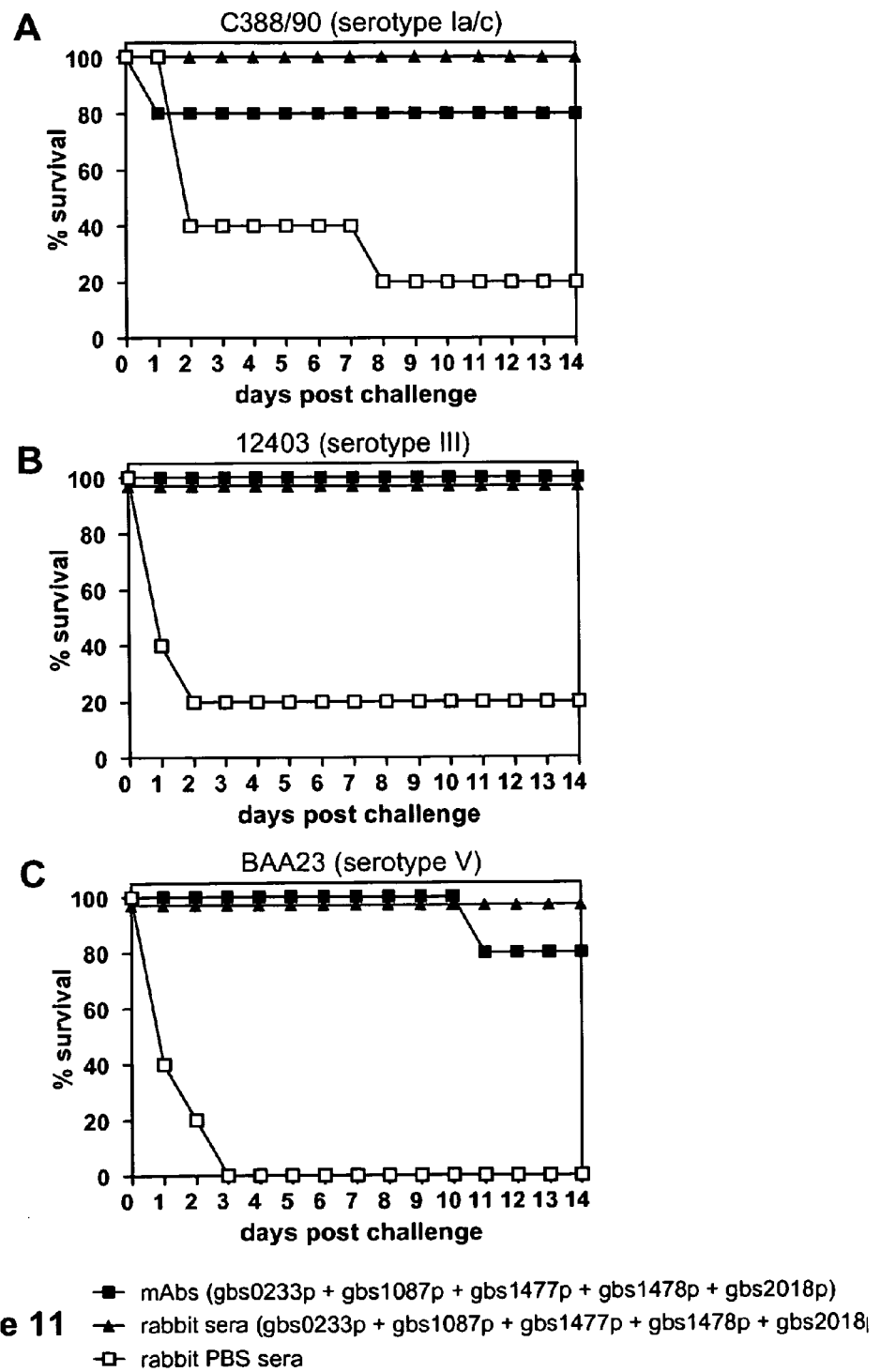
FIG. 11 shows the protection of adult mice by immunization with a combination of five mouse mAbs against different recombinant GBS antigens. CD-1 mice were immunized intraperitoneally with 25 µg of each mouse mAb. 1 to 3 hours later, mice were challenged intraperitoneally with (A) $1.2\times10^7$ cfu C388/90; (B) $9.6\times10^7$ cfu 12403 or (C) $1.7\times10^8$ cfu BAA23. Numbers of surviving mice are plotted as a percentage of the total number of challenged mice.

This invention includes also protection data by mouse monoclonal antibodies. mAbs were generated against gbs0233p, gbs1087p, gbs1477p, gbs1478p and gbs2018p. Selection of hybridoma supernatants were performed using antigen-specific ELISA and/or FACS analysis. Per antigen two mAbs were selected and tested in the passive transfer model using 50 μg purified mAb. We demonstrate in this invention that we obtain protection with a single mAb against at least one serotype (FIG. 10). In order to examine benefits of combinations of different mAb components, we performed passive protection studies by combining mAbs with different antigen specificities. We could demonstrate increased protection compared to the single mAbs against all the tested GBS serotypes. The best protection seen so far was achieved with a combination of mAbs against gbs0233p+gbs1087p+gbs1477p+gbs1478p+gbs2018p that protected most of the mice against all nine tested GBS strains (FIG. 11).

Example 5

Group B Streptococcal Antigens and Mouse Monoclonal Antibodies, Generated Against these Antigens, Induce Functional Antibodies Against Group B *Streptococcus*

Experimental Procedures
FACS Analysis

The *Streptococcus agalactiae* strain to be tested was inoculated from a glycerol stock into 5 ml THY medium and incubated over night at 37° C. The overnight culture was re-inoculated by adding 200 μl into 10 ml fresh THY medium and incubated until an $OD_{600\ nm}$ of approximately 1 was reach (~5×10$^8$ cells/ml). The bacteria were pelleted by centrifugation at 4,000 rpm for 5 min and washed twice with 2 ml HBSS. The final pellet was resuspended in HBSS with 1% BSA to give a cell density of 5×10$^6$ cells/ml. To 100 μl bacteria, 1 μl immune serum was added and incubated for 45 min on ice. Bacteria were pelleted by centrifugation at 1,000 g for 4 min and washed once with 150 μl HBSS with 1% BSA and resuspended in 100 μl HBSS with 1% BSA. To the opsonised bacteria, 1 μl of the secondary antibody (goat F(ab)2 fragment anti rabbit IgG coupled with PE) was added and incubated for 45 min on ice in dark. The cells were washed twice with 150 μl HBSS as described above and dissolved in 250 μl HBSS, the cells were fixed by addition of 250 μl 4% para-formaldehyde. The fluorescent staining of the bacteria was measured by flow cytometry.

Opsonophagocytic Killing Assay

Preparation of bacterial cells: The *Streptococcus agalactiae* strain to be tested was inoculated from a glycerol stock into 5 ml THY medium and incubated overnight at 37° C. The over night culture was re-inoculated by adding 200 μl into 10 ml fresh THY medium and incubated until an $OD_{600\ nm}$ of approximately 1 was reached. The bacteria were pelleted by centrifugation at 4,000 rpm for 5 min and washed twice with 2 ml HBSS. The final pellet was re-suspended in HBSS with 0.125% BSA to give a final concentration of 5×10$^4$ cells/85 μl.

Preparation of RAW264.7 cells: Cells were cultivated in T175 flasks with 25 ml DMEM high glucose medium at 37° C. with 5% $CO_2$. Cells were detached from the plates by scraping and collected by low speed centrifugation at 1,000 rpm for 10 min and washed twice with 50 ml HBSS with 10 mM glucose and re-suspended in HBSS with 10 mM glucose to give a cell concentration of 1×10$^7$ cells/ml.

Opsonophagocytic killing assay conditions: Bacterial cells (85 μl) were mixed with 10 μl guinea pig complement and 5 μl pre-diluted serum and incubated for 60 min at 6° C. with shaking (500 rpm). To the opsonised bacteria, 100 μl (1×10$^6$ cells) of RAW264.7 cells were added. Three aliquots of 10 μl were taken out and added to 1.5 ml water after 5 min incubation, 100 μwere plated out on blood agar plates. This CFU determination served as the initial bacterial count, $T_0$. The suspension of opsonised bacteria and RAW264.7 cells was further incubated at 37° C. with shaking (500 rpm) for 60 min and then the T60 was determined as described for the $T_0$. Blood agar plates were incubated overnight and the CFUs determined on the next day using a colony counter.

Evaluation: For each serum, the relationship between the CFUs at $T_0$ and $T_{60}$ was determined for the pre-immune and the immune serum. The percentage of killing of each immune serum was determined by the following formula: 100-100× (immune serum/preimmune serum). A reaction without sera was included in each assay as negative (complement) control.

Results

Figure 12:
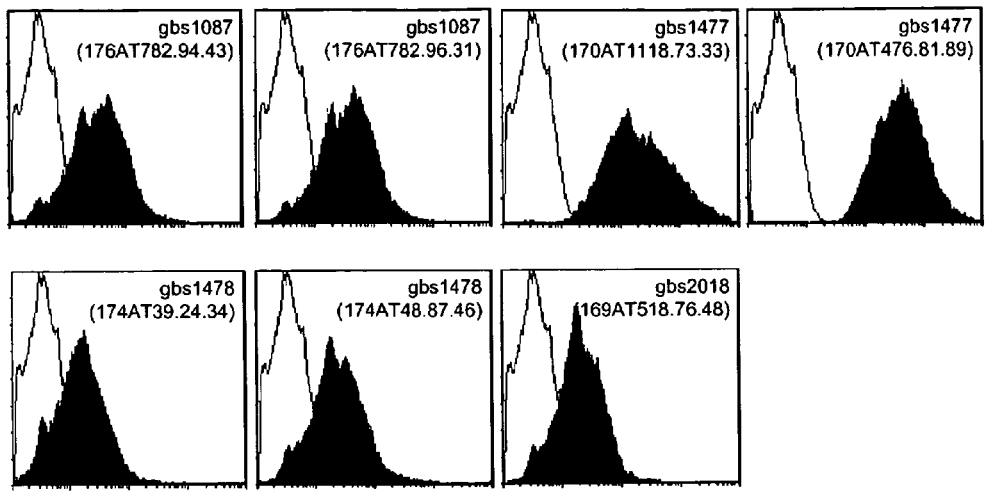
FIG. 12 shows surface staining of the serotype III GBS strain ATCC12403. The results for the monoclonal antibodies (black) are shown with the buffer control (white).
Figure 13:
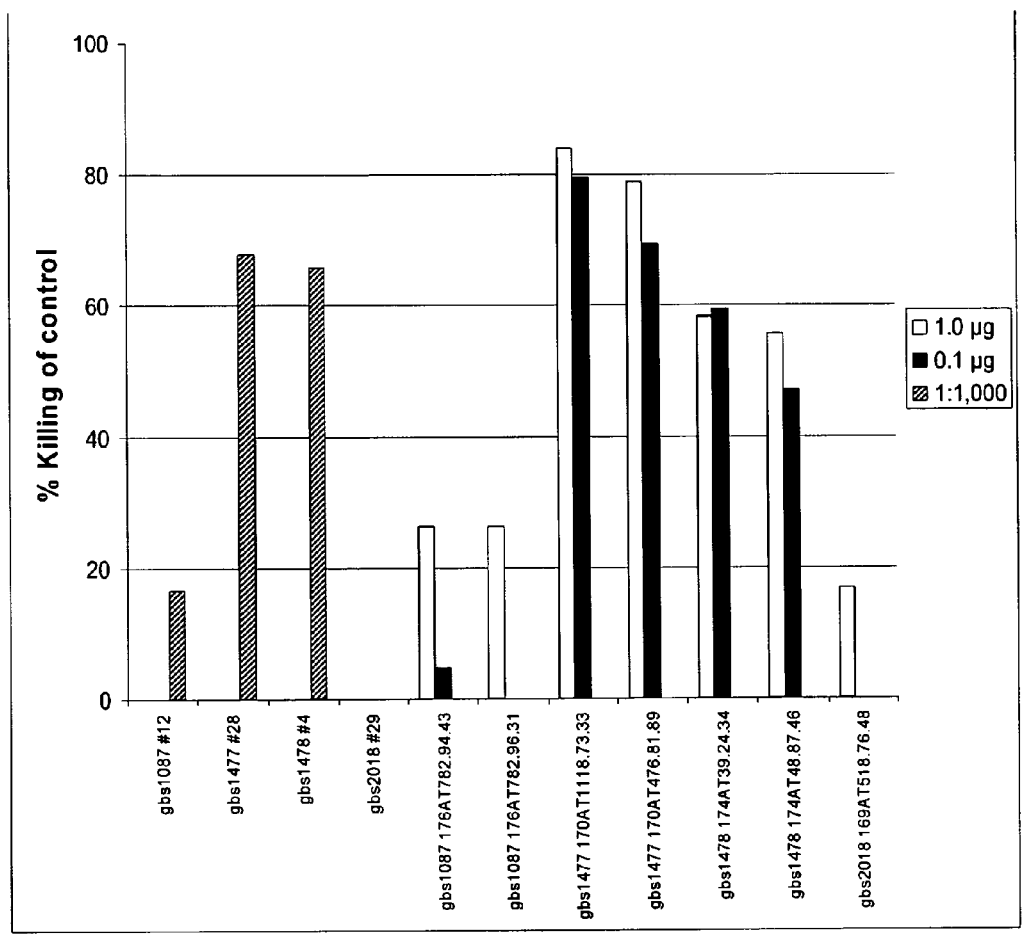
FIG. 13 shows opsonophagocytic killing assay with hyperimmune rabbit sera and different GBS strains. Rabbit sera were tested in the opsonophagocytic killing assay at a serum dilution of 1:1,000, % killing was calculated in relation to the respective pre-immune sera. The mouse monoclonal antibodies were tested with two different amounts added to the opsonophagocytic killing assay, 1.0 and 0.1 µg. The % killing for the monoclonal antibodies was calculated in relation to the complement control.

Based on the passive protection data, it is firmly established that protection by the selected six vaccine candidates is mainly mediated by antibodies. The ability to measure functional antibodies in in vitro assays is essential for the development of both a prophylactic vaccine and an antibody-based therapy or prevention. The same opsonophagocytic killing assay that was developed for the in vitro validation and used for selection of vaccine candidates was employed to analyze the hyperimmune rabbit sera for the presence of functional antibodies. Seven mouse monoclonal antibodies and four rabbit sera representing four antigens were tested in the opsonophagocytic killing assay for functional antibodies and staining in flow cytometry of the serotype III GBS strain ATCC12403 (FIGS. 12 and 13). All monoclonal antibodies bound to the serotype III GBS strain ATCC12403 as measured by flow cytometry (FIG. 12). The opsonophagocytic killing assay with the rabbit and mouse monoclonal antibodies are shown in FIG. 13. At a 1:1,000 dilution of the rabbit sera only gbs1477#28 and gbs1478#4 showed a high killing activity and gbs1087#12 showed low killing activity. The mouse monoclonal antibodies generated against gbs1477p and gbs1478p showed high killing activity and those against gbs1087p and gbs2018p showed only a killing activity at the higher concentration.

TABLE 1

List of genes selected for expression.
The nomenclature of the proteins is derived
from the genome of NEM316 (ATCC12403).
The strain and position (start/stop) of the amplicon
within the full length gene/protein are indicated.

| Construct | Gene | Full length | Strain | Vector | nt (start/stop) | SEQ ID NO | aa (start/stop) | SEQ ID NO |
|---|---|---|---|---|---|---|---|---|
| 1 | gbs0233 | 308 | 12403 | pET28b | 37-921 | 7 | 13-307 | 1 |
| 2 | gbs1087 | 442 | 6313 | pET28a | 106-1062 | 8 | 36-354 | 2 |
| 3 | gbs1309 | 403 | 12403 | pET28b | 4-1203 | 9 | 2-401 | 3 |
| 4 | gbs1477 | 674 | 6313 | pET28a | 88-1944 | 10 | 30-648 | 4 |
| 5 | gbs1478 | 901 | 6313 | pET28a | 88-2595 | 11 | 30-865 | 5 |
| 6 | gbs2018 | 643 | 12403 | pET28b | 106-1836 | 12 | 36-612 | 6 |

TABLE 2

List of *S. agalactiae* strains which were used for the first run of sequencing of the most of the genes of interest, and for which the genome has been published. (A complete list of strains used for the first and second run can be found in Table 13.)

| *S. agalactiae* strain | Serotype |
|---|---|
| GBS strains used for sequencing | |
| IC105 | IV |
| IC458 | Ia |
| 0176H4A | II |
| ATCC12401 | Ib |
| BAA23 | V |
| COH1 | III |
| ATCC12403 | III |
| 6313 | III |
| Published genomic GBS strains (Maione et al., 2005, Science 309(5731): 148-50) | |
| H36B | Ib |
| COH1 | III |
| CJB111 | V |
| A909 | Ia/c |
| 515 | Ia |
| 2603V/R | V |
| NEM316 (ATCC12403) | III |
| 18RS21 | II |

TABLE 3

Oligonucleotides used for PCR and sequencing

| ORF-protein | PCR | Sequencing Primer | Name | SEQ ID NO: |
|---|---|---|---|---|
| gbs0233 | ICC5455 & | GGGGGCACAATTCCTGTTAT | ICC 5455 | 13 |
| | ICC5456 | AAAAAGTGGTGGATAAATTGTTCT | ICC 5456 | 14 |
| gbs1087 | ICC5489 & | CATTGTAAATCTTAATGTTAGTATGA | ICC 5489 | 15 |
| | ICC5494 | TGACTTTGATTTCCAACACTATCC | ICC 5490 | 16 |
| | | GGTTTTAGAACTTGGAAATCAGGA | ICC 5491 | 17 |
| | | GGTCTATTAGCTACATTAGTAACCTG | ICC 5492 | 18 |
| | | AGAGAAATAATCACTCTAGTCAAGG | ICC 5493 | 19 |
| | | AAAAAGTCACCCTAACCAACC | ICC 5494 | 20 |
| gbs1309 | ICC5465 & | AATCATCGGTGAAGTGACGA | ICC 5465 | 21 |
| | ICC5468 | CGGTTAATTCAATTGGATATTTTCT | ICC 5466 | 22 |
| | | ACTCTGATATGGGTAAAGGCTAT | ICC 5467 | 23 |
| | | CTTGAATTATTCTTAAAAAGACCAAAA | ICC 5468 | 24 |
| | ICC5469 & | CCAGTAGATGAGTGGTTAGGTCTTG | ICC 5469 | 25 |
| | ICC5470 | AAGATGAGCTGGTTTTATATATTTG | ICC 5470 | 26 |
| gbs1477 | ICC5471 & | TTGCAGGTGGAATTTATATTTGG | ICC 5471 | 27 |
| | ICC5479 | TTCTTATCTACTTGTGGTTTTGTTTCA | ICC 5477 | 28 |
| | | TCTTGGCTGATTCAAAAGCA | ICC 5478 | 29 |
| | | GGTTCTGATGGGTTGATTGG | ICC 5479 | 30 |
| | ICC5480 & | AATGGCTCTTGCTTATGATCT | ICC 5472 | 31 |
| | ICC5472 | TGTTAGCGGCTACACTCCAG | ICC 5480 | 32 |
| | ICC5471 & | TTGCAGGTGGAATTTATATTTGG | ICC 5471 | 33 |
| | ICC5475 | CAACTTTTGGTTCAGTTGG | ICC 5475 | 34 |
| | | CCCATTGTCAAACCATTT | ICC 5473 | 35 |
| | | GCTACTGCTGAAATCGGTMA | ICC 5474 | 36 |
| | ICC5476 & | CATACATGGATCTCAGAACGT | ICC 5476 | 37 |
| | ICC5472 | AATGGCTCTTGCTTATGATCT | ICC 5472 | 38 |

TABLE 3-continued

Oligonucleotides used for PCR and sequencing

| ORF-protein | PCR | Sequencing Primer | Name | SEQ ID NO: |
|---|---|---|---|---|
| gbs1478 | ICC5481 & ICC5484 | TCTAGGATATTCTGTATCTGATCTTAG | ICC 5481 | 39 |
|  |  | CCATCAAAAATATCTGAACCA | ICC 5482 | 40 |
|  |  | GAGGGAACATTATCTAAACGTATTTCA | ICC 5483 | 41 |
|  |  | TTCAATTTTTGAAAAGTACCATCTTG | ICC 5484 | 42 |
|  | ICC5485 & ICC5488 | GAACATGGAACACCAACCAA | ICC 5485 | 43 |
|  |  | TCAATTTCACCTAACTTCTTCTCG | ICC 5486 | 44 |
|  |  | TTTTCCAATCCCTAAAATTCG | ICC 5487 | 45 |
|  |  | TTTTCATTTCTATCTCCTTCTTATTC | ICC 5488 | 46 |
| gbs2018 | ICC5457 & ICC5460 | AAAAGGCAAAGTTCTGATGAGG | ICC 5457 | 47 |
|  |  | AAAAATGCTTGATGAAGTCAAAA | ICC 5458 | 48 |
|  |  | GTTTGGCTTCTGGCTTAACG | ICC 5459 | 49 |
|  |  | TGATCAAGAACTAGGTAAGCAGTCA | ICC 5460 | 50 |
|  | ICC5461 & ICC5462 | CAAATTTAAGAATAAGTTGCGAATC | ICC 5461 | 51 |
|  |  | AGAGTAAATGATTTTAATAGAGCATCA | ICC 5462 | 52 |
|  | ICC5463 & ICC5464 | AAAATATTTCTAATTTCTGCTTCAGT | ICC 5463 | 53 |
|  |  | AATTAAAATAAACGTGGTCCTATCC | ICC 5464 | 54 |

TABLE 4

Sequence identity of proteins in published genomes of 8 GBS strains.
ORF indicates the name of the respective gene/protein in the genomic GBS strain. % Id, amino acid sequence identity in percentage. All comparisons are performed to the respective protein of GBS strain NEM316.

| ORF name (NEM316) | S. agalactiae H36B ORF | % Id | S. agalactiae COH1 ORF | % Id | S. agalactiae CJB111 ORF | % Id | S. agalactiae A909 ORF | % Id |
|---|---|---|---|---|---|---|---|---|
| gbs0233 | SAI_0243 | 99.0 | SAN_0021 | 99.7 | SAM_0244 | 99.0 | SAK_0301 | 99.0 |
| gbs1087 | SAI_2325 | 93.9 | SAN_1174 | 93.3 | SAM_1069 | 91.5 | SAK_1142 | 92.8 |
| gbs1309 | SAI_1330 | 99.4 | SAN_1370 | 69.9 | SAM_1259 | 100.0 | SAK_1321 | 99.7 |
| gbs1477 | SAI_1511 | 47.0 | none |  | SAM_1372 | 98.4 | none |  |
| gbs1478 | SAI_1512 | 87.7 | SAN_0702 | 43.2 | SAM_1373 | 99.1 | SAK_0780 | 43.3 |
| gbs2018 | SAI_2103 | 78.8 | SAN_2207 | 47.7 | SAM_1974 | 77.6 | SAK_1999 | 92.3 |

| ORF name (NEM316) | S. agalactiae 515 ORF | % Id | S. agalactiae 2603V/R ORF | % Id | S. agalactiae 18RS21 ORF | % Id |
|---|---|---|---|---|---|---|
| gbs0233 | SAL_0280 | 99.7 | SAG0242 | 99.0 | SAJ_0320 | 99.0 |
| gbs1087 | SAL_1159 | 92.0 | SAG1052 | 100.0 | SAJ_1090 | 100.0 |
| gbs1309 | SAL_1364 | 87.7 | SAG1237 | 99.7 | SAJ_2108 | 90.1 |
| gbs1477 | SAL_1486 | 75.9 | SAG1407 | 47.3 | SAJ_1416 | 47.3 |
| gbs1478 | SAL_1487 | 97.0 | SAG1408 | 97.3 | SAJ_1417 | 97.3 |
| gbs2018 | SAL_2118 | 100.0 | SAG2063 | 87.5 | SAJ_1966 | 87.5 |

TABLE 5

Sequence identity of proteins as determined by the first run of sequencing.
% Id, amino acid sequence identity of the respective protein in percentage as determined by DNA sequencing. All comparisons are performed to the respective protein of GBS strain NEM316.

| ORF name (NEM316) | S. agalactiae IC105 % Id | S. agalactiae IC458 % Id | S. agalactiae 12401 % Id | S. agalactiae BAA23 % Id | S. agalactiae COH1 % Id | S. agalactiae 0176H4A % Id |
|---|---|---|---|---|---|---|
| gbs0233 | 99.0 | 100 | 99.0 | 99.0 | 99.7 | 99.7 |
| gbs1087 | 86.0 | 95.2 | 93.9 | 91.5 | 92.7 | 98.6 |
| gbs1309 | 100 | 100 | 99.3 | 100 | 99.5 | 99.5 |
| gbs1477 | 48.9 | 49.3 | 48.8 | 98.4 | Not determined | 67.8 |
| gbs1478 | 88.2 | 88.1 | 87.7 | 99.1 | Not determined | Not determined |
| gbs2018 | 77.6 | 99.7 | 77.2 | 78.5 | Not determined | 80.2 |

TABLE 6

Sequence identity of gbs1477 proteins as determined by the first run of sequencing. % Id, amino acid sequence identity of the respective protein in percentage as determined by DNA sequencing. Pairwise comparisons are performed for the gbs1477 protein among the sequenced GBS strains.

| gbs1477 | S. agalactiae IC105 % Id | S. agalactiae IC458 % Id | S. agalactiae 12401 % Id | S. agalactiae BAA23 % Id | S. agalactiae 0176H4A % Id |
| --- | --- | --- | --- | --- | --- |
| S. agalactiae NEM316 | 48.9 | 49.3 | 48.8 | 98.4 | 67.8 |
| S. agalactiae IC105 | 100 | 58.6 | 99.9 | 49.4 | 48.0 |
| S. agalactiae IC458 | | 100 | 58.6 | 49.5 | 53.2 |
| S. agalactiae 12401 | | | 100 | 49.4 | 47.9 |
| S. agalactiae BAA23 | | | | 100 | 68.5 |
| S. agalactiae 0176H4A | | | | | 100 |

TABLE 7

Amino acid and encoding DNA sequences of gbs0233 proteins derived from different strains of S. agalactiae Strain 0176H4A
ORF DNA sequence (SEQ ID NO: 61)

ATGCTTAAAAAATCGCACTTTTTACAGATATTTACACTTTGCTTAGCCCTCTTAACGATTTCTGGTTGTCAA

TTAACCGATACTAAAAAACCTGGTCATACCACAATTAAGGTTGCTGCACAAAGTTCTACAGAGTCTAGTATC

ATGGCAAATATTGTCACCGAATTAATTCATCACGAATTAGGATACAACACAACTTTAATAAGCAATCTTGGT

TCCTCTACGGTTACTCACCAAGCTTTGCTCCGTGGTGATGCTGACATTGCTGCCACACGTTATACAGGAACA

GACATCACAGGAACTCTTGGCTTAAAAGCTGTTAAAGACCCTAAAGAAGCTTCTAAGATTGTAAAAACTGAA

TTCCAAAAACGCTACAATCAAACTTGGTATCCTACTTATGGTTTTTCTGATACTTATGCATTCATGGTTACT

AAAGAGTTTGCCAGACAGAATAAAATCACCAAGATCTCTGATCTCAAAAAATTATCAACAACTATGAAGGCA

GGGGTTGATAGTTCATGGATGAATCGCGAGGGAGATGGATACACTGATTTCGCTAAAACATACGGTTTTGAA

TTTTCACATATTTACCCTATGCAAATTGGCTTAGTCTATGATGCGGTTGAAAGTAACAAAATGCAATCTGTA

TTAGGCTACTCCACTGACGGTCGTATTTCGAGCTATGATTTAGAAATTTAAGGGATGATAAAAAATTCTTT

CCTCCTTATGAAGCCTCTATGGTTGTCAACAATTCTATCATCAAAAAAGATCCTAAACTAAAAAAATTACTC

CATCGACTCGATGGTAAAATCAATTTAAAAACGATGCAAAACCTTAATTATATGGTAGATGATAAACTTTTA

GAACCTTCAGTTGTTGCCAAACAATTTTTAGAAAAAAACCATTATTTTAGAGGAGATAAATAA

ORF amino acid sequence (SEQ ID NO: 55):

MLKKSHFLQIFTLCLALLTISGCQLTDTKKPGHTTIKVAAQSSTESSIMANIVTELIHHELGYNTTLISNLG

SSTVTHQALLRGDADIAATRYTGTDITGTLGLKAVKDPKEASKIVKTEFQKRYNQTWYPTYGFSDTYAFMVT

KEFARQNKITKISDLKKLSTTMKAGVDSSWMNREGDGYTDFAKTYGFEFSHIYPMQIGLVYDAVESNKMQSV

LGYSTDGRISSYDLEILRDDKKFFPPYEASMVVNNSIIKKDPKLKKLLHRLDGKINLKTMQNLNYMVDDKLL

EPSVVAKQFLEKNHYFRGDK

Strain 12401
ORF DNA sequence (SEQ ID NO: 62):

ATGCTTAAAAAATCGCACTTTTTACAGATATTTACACTTTGCTTAGCCCTCTTAACGATTTCTGGTTGTCAA

TTAACCGATACTAAAAAAGTCTGGTCATACCACAATTAAGGTTGCTGCCCAAAGTTCTACAGAGTCTAGTATT

ATGGCAAATATTATCACCGAATTAATTCATCACGAATTAGGATACAACACAACTTTAATAAGCAATCTTGGT

TCCTCTACGGTTACTCACCAAGCTTTGCTCCGTGGTGATGCTGACATTGCTGCCACACGTTATACAGGAACA

GACATCACAGGGACTCTTGGTTTAAAAGCTGTTAAAGACCCTAAAGAAGCTTCTAAGATTGTAAAAACTGAA

TTCCAAAAACGCTACAATCAAACTTGGTATCCTACTTATGGTTTTTCTGATACTTATGCATTCATGGTTACT

AAAGAGTTTGCCAGACAgAATAAAATCACTAAGATCTCTGATCTTAAAAAATTATCAACAACTATGAAGGCA

TABLE 7-continued

Amino acid and encoding DNA sequences of gbs0233 proteins
derived from different strains of *S. agalactiae*

GGGGTTGATAGTTCATGGATGAATCGCGAGGGAGATGGATACACTGATTTCGCTAAAACATACGGTTTTGAA

TTTTCACATATTTACCCTATGCAAATTGGCTTAGTCTATGATGCGGTTGAAAGTAACAAAATGCAATCTGTA

TTAGGCTACTCCACTGACGGTCGTATTTCGAGCTATGATTTAGAAATTTTAAGGGATGATAAAAAATTCTTT

CCTCCTTATGAAGCCTCTATGGTTGTCAACAATTCTATCATCAAAAAAGATCCTAAACTAAAAAAATTACTC

CATCGACTCGATGGTAAAATCAATTTAAAAACGATGCAAAACCTTAATTATATGGTAGATGATAAACTTTTA

GAACCTTCAGTTGTTGCCAAACAATTTTTAGAAAAAAACCATTATTTTAGAGGAGATAAATAA

ORF amino acid sequence (SEQ ID NO: 56)

MLKKSHFLQIFTLCLALLTISGCQLTDTKKSGHTTIKVAAQSSTESSIMANIITELIHHELGYNTTLISNLG

SSTVTHQALLRGDADIAATRYTGTDITGTLGLKAVKDPKEASKIVKTEFQKRYNQTWYPTYGFSDTYAFMVT

KEFARQNKITKISDLKKLSTTMKAGVDSSWMNREGDGYTDFAKTYGFEFSHIYPMQIGLVYDAVESNKMQSV

LGYSTDGRISSYDLEILRDDKKFFPPYEASMVVNNSIIKKDPKLKKLLHRLDGKINLKTMQNLNYMVDDKLL

EPSVVAKQFLEKNHYFRGDK

Strain BAA23
ORF DNA sequence (SEQ ID NO: 63)

ATGCTTAAAAAATCGCACTTTTTACAGATATTTACACTTTGCTTAGCCCTCTTAACGATTTCTGGTTGTCAA

TTAACCGATACTAAAAAGTCTGGTCATACCACAATTAAGGTTGCTGCCCAAAGTTCTACAGAGTCTAGTATT

ATGGCAAATATTATCACCGAATTAATTCATCACGAATTAGGATACAACACAACTTTAATAAGCAATCTTGGT

TCCTCTACGGTTACTCACCAAGCTTTGCTCCGTGGTGATGCTGACATTGCTGCCACACGTTATACAGGAACA

GACATCACAGGGACTCTTGGTTTAAAAGCTGTTAAAGACCCTAAAGAAGCTTCTAAGATTGTAAAAACTGAA

TTCCAAAAACGCTACAATCAAACTTGGTATCCTACTTATGGTTTTTCTGATACTTATGCATTCATGGTTACT

AAAGAGTTTGCCAGACAGAATAAAATCACTAAGATCTCTGATCTTAAAAAATTATCAACAACTATGAAGGCA

GGGGTTGATAGTTCATGGATGAATCGCGAGGGAGATGGATACACTGATTTCGCTAAAACATACGGTTTTGAA

TTTTCACATATTTACCCTATGCAAATTGGCTTAGTCTATGATGCGGTTGAAAGTAACAAAATGCAATCTGTA

TTAGGCTACTCCACTGACGGTCGTATTTCGAGCTATGATTTAGAAATTTTAAgGGATGATAAAAAATTCTTT

CCTCCTTATGAAGCCTCTATGGTTGTCAACAATTCTATCATCAAAAAAGATCCTAAACTAAAAAAATTACTC

CATCGACTCGATGGTAAAATCAATTTAAAAACGATGCAAAACCTTAATTATATGGTAGATGATAAACTTTTA

GAACCTTCAGTTGTTGCCAAACAATTTTTAGAAAAAAACCATTATTTTAGAGGAGATAAATAA

ORF amino acid sequence (SEQ ID NO: 57):

MLKKSHFLQIFTLCLALLTISGCQLTDTKKSGHTTIKVAAQSSTESSIMANIITELIHHELGYNTTLISNLG

SSTVTHQALLRGDADIAATRYTGTDITGTLGLKAVKDPKEASKIVKTEFQKRYNQTWYPTYGFSDTYAFMVT

KEFARQNKITKISDLKKLSTTMKAGVDSSWMNREGDGYTDFAKTYGFEFSHIYPMQIGLVYDAVESNKMQSV

LGYSTDGRISSYDLEILRDDKKFFPPYEASMVVNNSIIKKDPKLKKLLHRLDGKINLKTMQNLNYMVDDKLL

EPSVVAKQFLEKNHYFRGDK

Strain COH1
ORF DNA sequence (SEQ ID NO: 64):

ATGCTTAAAAAATCGCACTTTTTACAGATATTTACACTTTGCTTAGCCCTCTTAACGATTTCTGGTTGTCAA

TTAACCGATACTAAAAAACCTGGTCATACCACAATTAAGGTTGCTGCCCAAAGTTCTACAGAGTCTAGTATC

ATGGCAAATATTGTCACCGAATTAATTCATCACGAATTAGGATACAACACAACTTTAATAAGCAATCTTGGT

TCCTCTACGGTTACTCACCAAGCTTTGCTCCGTGGTGATGCTGACATTGCTGCCACACGTTATACAGGAACA

TABLE 7-continued

Amino acid and encoding DNA sequences of gbs0233 proteins
derived from different strains of *S. agalactiae*

```
GACATCACAGGAACTCTTGGCTTAAAAGCTGTTAAAGACCCTAAAGAAGCTTCTAAGATTGTAAAAACTGAA

TTCCAAAAACGCTACAATCAAACTTGGTATCCTACTTATGGTTTTTCTGATACTTATGCATTCATGGTTACT

AAAGAGTTTGCCAGACAGAATAAAATCACCAAGATCTCTGATCTCAAAAAGTTATCAACAACTATGAAGGCA

GGGGTTGATAGTTCATGGATGAATCGCGAGGGAGATGGATACACTGATTTCGCTAAAACATACGGTTTTGAA

TTTTCACATATTTACCCTATGCAAATTGGCTTAGTCTATGATGCGGTTGAAAGTAACAAATGCAATCTGTA

TTAGGCTACTCCACTGACGGTCGTATTTCGAGCTATGATTTAGAAATTTTAAGGGATGATAAAAAATTCTTT

CCTCCTTATGAAGCCTCTATGGTTGTCAACAATTCTATCATCAAAAAAGATCCTAAACTAAAAAAATTACTC

CATCGACTCGATGGTAAAATCAATTTAAAAACGATGCAAAACCTTAATTATATGGTAGATGATAAACTTTTA

GAACCTTCAGTTGTTGCCAAACAATTTTTAGAAAAAAACCATTATTTTAGAGGAGATAAATAA
```

ORF amino acid sequence (SEQ ID NO: 58):

```
MLKKSHFLQIFTLCLALLTISGCQLTDTKKPGHTTIKVAAQSSTESSIMANIVTELIHHELGYNTTLISNLG

SSTVTHQALLRGDADIAATRYTGTDITGTLGLKAVKDPKEASKIVKTEFQKRYNQTWYPTYGFSDTYAFMVT

KEFARQNKITKISDLKKLSTTMKAGVDSSWMNREGDGYTDFAKTYGFEFSHIYPMQIGLVYDAVESNKMQSV

LGYSTDGRISSYDLEILRDDKKFFPPYEASMVVNNSIIKKDPKLKKLLHRLDGKINLKTMQNLNYMVDDKLL

EPSVVAKQFLEKNHYFRGDK
```

Strain IC105
ORF DNA sequence (SEQ ID NO: 65):

```
ATGCTTAAAAAATCGCACTTTTTACAGATATTTACACTTTGCTTAGCCCTCTTAACGATTTCTGGTTGTCAA

TTAACCGATACTAAAAAAGTCTGGTCATACCACAATTAAGGTTGCTGCCCAAAGTTCTACAGAGTCTAGTATT

ATGGCAAATATTATCACCGAATTAATTCATCACGAATTAGGATACAACACAACTTTAATAAGCAATCTTGGT

TCCTCTACGGTTACTCACCAAGCTTTGCTCCGTGGTGATGCTGACATTGCTGCCACACGTTATACAGGAACA

GACATCACAGGGACTCTTGGTTTAAAAGCTGTTAAAGACCCTAAAGAAGCTTCTAAGATTGTAAAAACTGAA

TTCCAAAAACGCTACAATCAAACTTGGTATCCTACTTATGGTTTTTCTGATACTTATGCATTCATGGTTACT

AAAGAGTTTGCCAGACAGAATAAAATCACTAAGATCTCTGATCTTAAAAAATTATCAACAACTATGAAGGCA

GGGGTTGATAGTTCATGGATGAATCGCGAGGGAGATGGATACACTGATTTCGCTAAAACATACGGTTTTGAA

TTTTCACATATTTACCCTATGCAAATTGGCTTAGTCTATGATGCGGTTGAAAGTAACAAATGCAATCTGTA

TTAGGCTACTCCACTGACGGTCGTATTTCGAGCTATGATTTAGAAATTTTAAGGGATGATAAAAAATTCTTT

CCTCCTTATGAAGCCTCTATGGTTGTCAACAATTCTATCATCAAAAAAGATCCTAAACTAAAAAAATTACTC

CATCGACTCGATGGTAAAATCAATTTAAAAACGATGCAAAACCTTAATTATATGGTAGATGATAAACTTTTA

GAACCTTCAGTTGTTGCCAAACAATTTTTAGAAAAAAACCATTATTTTAGAGGAGATAAATAA
```

ORF amino acid sequence (SEQ ID NO: 59):

```
MLKKSHFLQIFTLCLALLTISGCQLTDTKKSGHTTIKVAAQSSTESSIMANIITELIHHELGYNTTLISNLG

SSTVTHQALLRGDADIAATRYTGTDITGTLGLKAVKDPKEASKIVKTEFQKRYNQTWYPTYGFSDTYAFMVT

KEFARQNKITKISDLKKLSTTMKAGVDSSWMNREGDGYTDFAKTYGFEFSHIYPMQIGLVYDAVESNKMQSV

LGYSTDGRISSYDLEILRDDKKFFPPYEASMVVNNSIIKKDPKLKKLLHRLDGKINLKTMQNLNYMVDDKLL

EPSVVAKQFLEKNHYFRGDK
```

Strain IC458
ORF DNA sequence (SEQ ID NO: 66):

```
ATGCTTAAAAAATCGCACTTTTTACAGATATTTACACTTTGCTTAGCCCTCTTAACGATTTCTGGTTGTCAA

TTAACCGATACTAAAAAACCTGGTCATACCACAATTAAGGTTGCTGCCCAAAGTTCTACAGAGTCTAGTATC
```

TABLE 7-continued

Amino acid and encoding DNA sequences of gbs0233 proteins derived from different strains of *S. agalactiae*

ATGGCAAATATTGTCACCGAATTAATTCATCACGAATTAgGATACAACACAACTTTAATAAGCAATCTTGGT

TCCTCTACGGTTACTCACCAAGCTTTGCTCCGTGGTGATGCTGACATTGCTGCCACACGTTATACAGGAACA

GACATCAcAGGAACTCTTGGCTTAAAAGCTGTTAAAGACACTAAAGAAGCTTCTAAGATTGTAAAAACTGAA

TTCCAAAAACGCTACAATCAAACTTGGTATCCTACTTATGGTTTTTCTGATACTTATGCATTCATGGTTACT

AAAgAGTTTGCCAGACAGAAtAAAATCACCAAGATCTCTGAtCTCAAAAAgTTATCAACAACTATGAAGGCA

GGGGTTGATAGTTCATGGATGAATCGCGAGGGAGATGGATACACTGATTTCGCTAAAACATACGGTTTTGAA

TTTTCACATATTTACCCTATGCAAATTGGCTTAGTCTATGATGCAGTTGAAAGTAACAAAATGCAATCTGTA

TTAGGCTACTCCACTGACGGTCGTATTTCGAGCTATGATTTAGAAATTTTAAGGGATGATAAAAAATTCTTT

CCTCCTTATGAAGCCTCTATGGTTGTCAACAATTCTATCATCAAAAAAGATCCTAAACTAAAAAAATTACTC

CATCGACTCGATGGTAAAATCAATTTAAAAACGATGCAAAACCTTAATTATATGGTAGATGATAAACTTTTA

GAACCTTCAGTTGTTGCCAAACAATTTTTAGAAAAAAACCATTATTTTAGAGGAGATAAATAA

ORF amino acid sequence (SEQ ID NO: 60):

MLKKSHFLQIFTLCLALLTISGCQLTDTKKPGHTTIKVAAQSSTESSIMANIVTELIHHELGYNTTLISNLG

SSTVTHQALLRGDADIAATRYTGTDITGTLGLKAVKDTKEASKIVKTEFQKRYNQTWYPTYGFSDTYAFMVT

KEFARQNKITKISDLKKLSTTMKAGVDSSWMNREGDGYTDFAKTYGFEFSHIYPMQIGLVYDAVESNKMQSV

LGYSTDGRISSYDLEILRDDKKFFPPYEASMVVNNSIIKKDPKLKKLLHRLDGKINLKTMQNLNYMVDDKLL

EPSVVAKQFLEKNHYFRGDK

TABLE 8

Amino acid and encoding DNA sequences of gbs1087 proteins derived from different strains of *S. agalactiae*

Strain 0176H4A
ORF DNA sequence (SEQ ID NO: 73):

TTGTTCAATAAAATAGGTTTTAGAACTTGGAAATCAGGAAAGCTTTGGCTTTATATGGGAGTGCTAGGATCA

ACTATTATTTTAGGATCAAGTCCTGTATCTGCTATGGATAGTGTTGGAAATCAAAGTCAGGGCAATGTTTTA

GAGCGTCGTCAACGCGATGCAGAAAACAGAAGCCAAGGTAATGTTCTAGAGCGTCGTCAACGCGATGCAGAA

AACAGAAGCCAAGGTAATGTTCTAGAGCGTCGTCAACGTGATGCGGAAAACAAGAGCCAAGTAGGTCAACTT

ATAGGGAAAAATCCACTTCTTTCAAAGTCAATTATATCTAGAGAAAATAATCACTCTAGTCAAGGTGACTCT

AACAAACAGTCATTCTCTAAAAAAGTATCTCAGGTTACTAATGTAGCTAATAGACCGATGTTAACTAATAAT

TCTAGAACAATTTCAGTGATAAATAAATTACCTAAAACAGGTGATGATCAAAATGTCATTTTTAAACTTGTA

GGTTTTGGTTTAATTTTGTTAACAAGTCGCTGCGGTTTGAGACGCAATGAAAATTAA

ORF amino acid sequence (SEQ ID NO: 67):

LFNKIGFRTWKSGKLWLYMGVLGSTIILGSSPVSAMDSVGNQSQGNVLERRQRDAENRSQGNVLERRQRDAE

NRSQGNVLERRQRDAENKSQVGQLIGKNPLLSKSIISRENNHSSQGDSNKQSFSKKVSQVTNVANRPMLTNN

SRTISVINKLPKTGDDQNVIFKLVGFGLILLTSRCGLRRNEN

Strain 12401
ORF DNA sequence (SEQ ID NO: 74):

TTGTTCAATAAAATAGGTTTTAGAACTTGGAAATCAGGAAAGCTTTGGCTTTATATGGGAGTGCTAGGATCA

ACTATTATTTTAGGATCAAGTCCTGTATCTGCTATGGATAGTGTTGGAAATCAAAGTCAAGGTAATGTTCTA

TABLE 8-continued

Amino acid and encoding DNA sequences of gbs1087 proteins
derived from different strains of *S. agalactiae*

GAGCGTCGTCAACGTGATGCGGATAACAAGAGCCAAGGTAATGTTCTAGAACGTCGTCAACGCGATGTGGAA

AACAAAAGTCAGGGCAATGTTCTAGAACGTCGTCAACGTGATGTTGAGAATAAGAGCCAAGGCAATGTTCTA

GAGCGTCGCCAACGTGATGCAGAAAACAAAAGTCAGGGTAATGTTCTAGAGCGTCGTCAACGCGATGCAGAT

AACAAGAGCCAAGGTAATGTTCTAGAACGTCGTCAACGCGATGTGGAAAACAAAAGTCAGGGCAATGTTCTA

GAGCGTCGCCAACGTGATGTTGAGAACAAGAGCCAAGTAGGTCAACTTATAGGGAAAAATCCACTTCTTTCA

AAGTCAACTATATCTAGAGAAAATAATCACTCTAGTCAAGGTGACTCTAACAAACAGTCATTCTCTAAAAAA

GTATCTCAGGTTACTAATGTAGCTAATAGACCAATGTTAACTAATAATTCTAGAACAATTTCAGTGATAAAT

AAATTACCTAAAACAGGTGATGATCAAAATGTCATTTTTAAACTTGTAGGTTTTGGTTTAATTTTGTTAACA

AGTCGCTGCGGTTTGAGACGCAATGAAAATTAA

ORF amino acid sequence (SEQ ID NO: 68):

LFNKIGFRTWKSGKLWLYMGVLGSTIILGSSPVSAMDSVGNQSQGNVLERRQRDADNKSQGNVLERRQRDVE

NKSQGNVLERRQRDVENKSQGNVLERRQRDAENKSQGNVLERRQRDADNKSQGNVLERRQRDVENKSQGNVL

ERRQRDVENKSQVGQLIGKNPLLSKSTISRENNHSSQGDSNKQSFSKKVSQVTNVANRPMLTNNSRTISVIN

KLPKTGDDQNVIFKLVGFGLILLTSRCGLRRNEN

Strain BAA23
ORF DNA sequence (SEQ ID NO: 75):

TTGTTCAATAAAATAGGTTTTAGAACTTGGAAATCAGGAAAGCTTTGGCTTTATATGGGAGTGCTAGGATCA

ACTATTATTTTAGGATCAAGTCCTGTATCTGCTATGGATAGTGTTGGAAATCAAAGTCAGGGCAATGTTTTA

GAGCGTCGTCAACGTGATGCAGAAAACAGAAGCCAAGGTAATGTTCTAGAGCGTCGTCAACGTGATGCAGAA

AACAGAAGCCAAGGTAATGTTCTAGAGCGTCGTCAACGCGATGCAGAAAACAGAAGCCAAGGTAATGTTCTA

GAGCGTCGTCAACGTGATGTTGAGAATAAGAGCCAAGGCAATGTTTTAGAGCGTCGTCAACGCGATGTTGAG

AATAAGAGCCAAGGTAATGTTCTAGAGCGTCGTCAACGTGATGCGGAAAACAAGAGCCAAGGCAATGTTCTA

GAGCGTCGTCAACGTGATGCGGAAAACAAGAGCCAAGGCAATGTTCTAGAGCGTCGTCAACGCGATGCAGAA

AACAGAAGCCAAGGTAATGTTTTAGAACGTCGTCAACGCGATGTTGAGAACAAGAGCCAAGGTAACGTTCTA

GAGCGTCGCCAACGTGACGTTGAGAACAAGAGCCAAGGTAATGTTTTAGAGCGTCGCCAACGCGATGCGGAT

AACAAAAGTCAGGGCAATGTTTTAGAGCGTCGCCAACGTGATGTTGAGAACAAGAGCCAAGGTAATGTTCTA

GAGCGTCGCCAAAATAATGTCCTTATTAAGAGTCAAGATAATGTTCTAGAGCGCCGCCAACGTGATGCGGAT

AACAAGAGCCAGGGTAACGTTCTAGAGCGTCGTCAACGCGATGTTGAGAATAAGAGCCAAGGTAATGTTTTA

GAGCGTCGCCAACATGATGTTGAGAATAAGAGTCAAGTAGGTCAACTTATAGGGAAAAATCCACTTTTTTCA

AAGTCAACTGTATCTAGAGAAAATAATCACTCTAGTCAAGGTGACTCTAACAAACAGTCATTCTCTAAAAAA

GTATCTCAGGTTACTAATGTAGCTAATAGACCGATGTTAACTAATAATTCTAGAACAATTTCAGTGATAAAT

AAATTACCTAAAACAGGTGATGATCAAAATGTCATTTTTAAACTTGTAGGTTTTGGTTTAATTTTATTAACA

AGTCTCTGCGGTTTGAGACGCAATGAAAATTAA

ORF amino acid sequence (SEQ ID NO: 69):

LFNKIGFRTWKSGKLWLYMGVLGSTIILGSSPVSAMDSVGNQSQGNVLERRQRDAENRSQGNVLERRQRDAE

NRSQGNVLERRQRDAENRSQGNVLERRQRDVENKSQGNVLERRQRDVENKSQGNVLERRQRDAENKSQGNVL

ERRQRDAENKSQGNVLERRQRDAENRSQGNVLERRQRDVENKSQGNVLERRQRDVENKSQGNVLERRQRDAD

NKSQGNVLERRQRDVENKSQGNVLERRQNNVLIKSQDNVLERRQRDADNKSQGNVLERRQRDVENKSQGNVL

TABLE 8-continued

Amino acid and encoding DNA sequences of gbs1087 proteins
derived from different strains of *S. agalactiae*

ERRQHDVENKSQVGQLIGKNPLFSKSTVSRENNHSSQGDSNKQSFSKKVSQVTNVANRPMLTNNSRTISVIN

KLPKTGDDQNVIFKLVGFGLILLTSLCGLRRNEN

Strain COH1
ORF DNA sequence (SEQ ID NO: 76):

TTGTTCAATAAAATAGGTTTTAGAACTTGGAAATCAGGAAAGCTTTGGCTTTATATGGGAGTGCTAGGATCA

ACTATTATTTTAGGATCAAGTCCTGTATCTGCTATGGATAGTGTTGGAAATCAAAGTCAAGGTAATGTTTTA

GAGCGTCGCCAACGTGATGCGGAAAACAAAAGTCAGGGTAATGTTTTAGAGCGTCGCCAACGTGATGCGGAA

AACAAGAGCCAAGGCAATGTTTTAGAGCGTCGTCAACGCGATGTTGAGAATAAGAGCCAAGGCAATGTTTTA

GAGCGTCGTCAACGTGATGCGGAAAACAAAAGTCAGGGCAATGTTCTAGAGCGCCGCCAACGTGATGCGGAT

AACAAGAGCCAAGTAGGTCAACTTATAGGGAAAAATCCACTTTTTTCAAAGCCAACTGTATCTAGAGAAAAT

AATCACTCTAGTCAAGGTGACTCTAACAAACAGTCATTCTCTAAAAAAGTATCTCAGGTTACTAATGTAGCT

AATAGACCGATGTTAACTAATAATTCTAGAACAATTTCAGTGATAAATAAATTACCTAAAACAGGTGGTGAT

CAAAATGTCATTTTTAAACTTGTAGGTTTTGGTTTAATTTTGTTAACAAGTCGCTGCGGTTTGAGACGCAAT

GAAAATTAA

ORF amino acid sequence (SEQ ID NO: 70):

LFNKIGFRTWKSGKLWLYMGVLGSTIILGSSPVSAMDSVGNQSQGNVLERRQRDAENKSQGNVLERRQRDAE

NKSQGNVLERRQRDVENKSQGNVLERRQRDAENKSQGNVLERRQRDADNKSQVGQLIGKNPLFSKPTVSREN

NHSSQGDSNKQSFSKKVSQVTNVANRPMLTNNSRTISVINKLPKTGGDQNVIFKLVGFGLILLTSRCGLRRN

EN

Strain IC105
ORF DNA sequence (SEQ ID NO: 77):

TTGTTCAATAAAATAGGTTTTAGAACTTGGAAATCAGGAAAGCTTTGGCTTTATATGGGAGTGCTAGGATCa actattattttaggatcaagtcctgtttctgCTATGGATAGTGATGGAAATCAAAGTCAGGGCAATGTTTTA

GAGCGTCGTCAACGTGATGCGGAAAACAAGAGCCAAGGCAATGTTCTAGAGCGTCGTCAACGCGATGCAGAA

AACAGAAGCCAAGGTAATGATCTAGAGCGTCGCCAACGTGACGTTGAGAACAAGAGCCAAGGTAACGTTCTA

GAGCGTCGTCAACGTGATGCAGATAACAAGAGCCAGGGCAATGTTTTAGAGCGTCGCCAACGTGATGTTGAG

AACAAGAGCCAAGGTAATGTTCTAGAGCGTCGCCAAAATAATGTCCTTATTAAGAGTCAAGATAATGATCTA

GAGCGCCGCCAACGTGATGCGGATAACAAGAGCCAGGGTAACGTTCTAGAGCGTCGCCAACGTGATGTTGAG

AACAAGAGCCAAGGTAATGTTCTAGAGCGCCGCCAACGTGATGCGGATAACAAGAGCCAGGGTAACGTTCTA

GAGTGTCGCCAACGTGATGTTGAGAACAAGAGCCAAGGTAATGTTCTAGAGCGTCGTCAACGTGATGCGGAA

AACAAGAGCCAAGGCAATGTTCTAGAGCGTCGTCAACGCGATGCAGAAAACAGAAGCCAAGGTAATGTTCTA

GAGCGTCGCCAACGTGACGTTGAGAACAAGAGCCAAGGTAACGTTCTAGAGCGTCGTCAACGTGATGCAGAT

AACAAGAGCCAGGGCAATGTTTTAGAGCGTCGCCAACGTGATGTTGAGAACAAGAGCCAAGGTAATGTTCTA

GAGCGTCGCCAAAATAATGTCCTTATTAAGAGTCAAGATAATGTTCTAGAGCGCCGCCAACGTGATGCGGAT

AACAAGAGCCAGGGTAACGTTCTAGAGCGTCGCCAACGTGATGTTGAGAACAAGAGCCAAGGCAATGTTTTA

GAGCGTCGTCAACGCGATGTTGAGAATAAGAGTCAAGTAGGTCAACTTATAGGGAAAAATCCACTTTTTTCA

AAGTCAACTGTATCTAGAGAAAATAATCACTCTAGTCAAGGTGACTCTAACAAACAGTCATTCTCTAAAAAA

GTATCTCAGGTTACTAATGTAGCTAATAGACCGATGTTAACTAATAATTCTAGAACAATTTCAGTGATAAAT

TABLE 8-continued

Amino acid and encoding DNA sequences of gbs1087 proteins derived from different strains of S. agalactiae

AAATTACCTAAAACAGGTGATGATCAAAATGTCATTTTTAAACTTGTAGGTTTTGGTTTAATTTTATTAACA

AGTCTCTGCGGTTTGAGACGCAATGAAAATTAA

ORF amino acid sequence (SEQ ID NO: 71):

LFNKIGFRTWKSGKLWLYMGVLGSTIILGSSPVSAMDSDGNQSQGNVLERRQRDAENKSQGNVLERRQRDAE

NRSQGNDLERRQRDVENKSQGNVLERRQRDADNKSQGNVLERRQRDVENKSQGNVLERRQNNVLIKSQDNDL

ERRQRDADNKSQGNVLERRQRDVENKSQGNVLERRQRDADNKSQGNVLECRQRDVENKSQGNVLERRQRDAE

NKSQGNVLERRQRDAENRSQGNVLERRQRDVENKSQGNVLERRQRDADNKSQGNVLERRQRDVENKSQGNVL

ERRQNNVLIKSQDNVLERRQRDADNKSQGNVLERRQRDVENKSQGNVLERRQRDVENKSQVGQLIGKNPLFS

KSTVSRENNHSSQGDSNKQSFSKKVSQVTNVANRPMLTNNSRTISVINKLPKTGDDQNVIFKLVGFGLILLT

SLCGLRRNEN

Strain IC458
ORF DNA sequence (SEQ ID NO: 78):

TTGTTCAATAAAATAGGTTTTAGAACTTGGAAATCAGGAAAGCTTTGGCTTTATATGGGAGTGCTAGGATCA

ACTATTATTTTAGGATCAAGTCCTGTATCTGCTATGGATAGTGTTGGAAATCAAAGTCAGGGCAATGTTTTA

GAGCGTCGTCAACGCGATGTTGAGAATAAGAGCCAAGGTAATGTTCTAGAGCGTCGTCAACGTGATGCGGAA

AACAAGAGCCAAGGCAATGTTTTAGAGCGTCGTCAACGTGATGCAGAAAACAGAAGCCAAGGCAATGTTTTA

GAGCGTCGTCAACGTGATGCAGAAAACAGAAGCCAAGGCAATGTTTTAGAGCGTCGTCAACGCGATGTTGAG

AATAAGAGCCAAGGTAATGTTCTAGAGCGTCGTCAACGCGATGTTGAGAATAAGAGCCAAGGTAATGTTCTA

GAGCGTCGTCAACGTGATGCGGAAAACAAGAGCCAAGGCAATGTTTTAGAGCGTCGTCAACGTGATGCAGAA

AACAGAAGCCAAGGCAATGTTTTAGAGCGTCGTCAACGTGATGCAGAAAACAGAAGCCAAGGCAATGTTTTA

GAGCGTCGTCAACGCGATGTTGAGAATAAGAGCCAAGGCAATGTTTTAGAGCGTCGTCAACGTGATGCAGAA

AACAGAAGCCAAGGCAATGTTTTAGAGCGTCGTCAACGTGATGCAGAAAACAGAAGCCAAGTAGGTCAACTT

ATAGGGAAAAATCCACTTCTTTCAAAGTCAATTATATCTAGAGAAAATAATCACTCTAGTCAAGGTGACTCT

AACAAACAGTCATTCTCTAAAAAAGTATCTCAGGTTACTAATGTAGCTAATAGACCGATGTTAACTAATAAT

TCTAGAACAATTTCAGTGATAAATAAATTACCTAAAACAGGTGATGATCAAAATGTCATTTTTAAACTTGTA

GGTTTTGGTTTAATTTTGTTAACAAGTCGCTGCGGTTTGAGACGCAATGAAAATTAA

ORF amino acid sequence (SEQ ID NO: 72):

LFNKIGFRTWKSGKLWLYMGVLGSTIILGSSPVSAMDSVGNQSQGNVLERRQRDVENKSQGNVLERRQRDAE

NKSQGNVLERRQRDAENRSQGNVLERRQRDAENRSQGNVLERRQRDVENKSQGNVLERRQRDVENKSQGNVL

ERRQRDAENKSQGNVLERRQRDAENRSQGNVLERRQRDAENRSQGNVLERRQRDVENKSQGNVLERRQRDAE

NRSQGNVLERRQRDAENRSQVGQLIGKNPLLSKSIISRENNHSSQGDSNKQSFSKKVSQVTNVANRPMLTNN

SRTISVINKLPKTGDDQNVIFKLVGFGLILLTSRCGLRRNEN

TABLE 9

Amino acid and encoding DNA sequences of gbs1309 proteins derived from different strains of S. agalactiae Strain 0176H4A
ORF DNA sequence (SEQ ID NO: 85):

TTTAGTGTAACCTATTCACAGTCTGAACGTACGGTTGTTTCTCTTTTGGAGAAATAACATTTAGTAGGAGT

CGCTGGACAAATGGCTTTGAAACTAGAATACCAGTAGATGAGTGGTTAGGTCTTGAAAAATATAAGAGATAT

TABLE 9-continued

Amino acid and encoding DNA sequences of gbs1309 proteins
derived from different strains of *S. agalactiae*

TCAATAGAATTCTTATATCATGTTGCAAAATTGGCTACAATGATGCCTTATCGTCAAGTTTGCAAAGTAATA

GATAGCACTTTGCAAACAATCATAACAAAAGACTGTGTTTTAAAAGCAGTAAAATTTGTAGAAAAATTGTTA

AAAGAAAAGAACGCTATCGTTTTTATTTGGAAGAGCCACCCGAACGTAAAAAAGTGAAAAAACTGTATGTT

GAGGGTGATGGAGTCATGATTAAAAGCACAGATTCTAGAGAGGAAAGAAGGTATTTAGATTTAACACATTTT

GTTATTCATACAGGCTCAAAAAAGTTTCTACTAAAAGATATGAATTGCAGGACAAGCACGAAATATTACAG

CTTAATTATGATAAAGCTAAATATAATCTTTTAGATTATATTTATAATAACTATGAAGTAGATGACGATACT

ATTTTAATCACTAACTCTGATATGGGTAAAGGCTATACTAGTAGAGTTTTTAAGGAATTAGGAAAAGCACTT

AAGGTAAAGAAACATGAGCATTTTTGGGATATCTATCATGTTAAAGAAAAGTTAAGTTCATACCTTAGAAAA

TATCCAATTGAATTAACCGATTTTACTTTAGATGCGGTAAAAAAATATAATTCTGATAAGCTTGAATTAGTT

TTTGATACTGTTGAATCACTGATTTGTGATGAACTTGAAGATCAAGAATTTCAGAAGTTTAAGAAAAAGTA

TTAAATAATTTCAAATATATAAAACCAGCTCATCTTAGAAATCTTTCAAATCGTGGTATTGGTATCATGGAA

TCACAACACAGAAAGATAACGTATAGAATGAAGCGACGTGGCATGTATTGGTCAAAGTGGGGAATCTCCACA

ATGGCAAATATGATTATATTTGAAAGAGCTAACGGTTTACGAGAATTATTTTTCGGTTCTTGGAGAAAGGTA

TACAGTGAGTATAAAGAAGGTTCATTTAGTGCAGGGCGACTTTTTAAAAAGACAGATGAATTAGATAAATTT

TCTAAGCCCCTTCTAAAAAATGGCAGAAAATGGAGTATAACAGGAATCAAAACAAAATAG

ORF amino acid sequence (SEQ ID NO: 79):

FSVTYSQSERTVVFSFGEITFSRSRWTNGFETRIPVDEWLGLEKYKRYSIEFLYHVAKLATMMPYRQVCKVI

DSTLQTIITKDCVLKAVKFVEKLLKEKERYRFYLEEPPERKKVKKLYVEGDGVMIKSTDSREERRYLDLTHF

VIHTGSKKVSTKRYELQDKHEILQLNYDKAKYNLLDYIYNNYEVDDDTILITNSDMGKGYTSRVFKELGKAL

KVKKHEHFWDIYHVKEKLSSYLRKYPIELTDFTLDAVKKYNSDKLELVFDTVESLICDELEDQEFQKFKKKV

LNNFKYIKPAHLRNLSNRGIGIMESQHRKITYRMKRRGMYWSKWGISTMANMIIFERANGLRELFFGSWRKV

YSEYKEGSFSAGRLFKKTDELDKFSKPLLKNGRKWSITGIKTK

Strain 12401
ORF DNA sequence (SEQ ID NO: 86):

TTTAGTGTAACCTATTCACAGTCTGAACGTACGGTTGTTTTCTCTTTTGGAGAAATAACATTTAGTAGGAGT

CGCTGGACAAATGGCTTTGAAACTAGAATACCAGTAGATGAGTGGTTAGGTCTTGAAAAATATAAGAGATAT

TCAATAGAATTCTTATATCATGTTGCAAAATTGGCTACAATGATGCCTTATtGTCAAGTTTGCAAAGTAATA

GATAGCACTTTGCAAACAATCATAACAAAAGACTGTGTTTTAAAAGCAGTAAAATTTGTAGAAAAATTGTTA

AAAGAAAAGAACGCTATCGTTTTTATTTGGAAGAGCCACCCGAACgTAAAAAAGtGAAAAAACTGTATGTT

GaGGGTGATGGAGTCATGATTAAAAGCACAGATTCTAGAGAGGAAAGAAGGTATTTAGATTTAACACATTTT

GTTATTCATACAGGCTCAAAAAAGTTTCTACTAAAAGATATGAATTGCAGGACAAGCACGAAATATTACAG

CTTAATTATGATAAAGCTAAATATAATCTTTTAGATTATATTTATAATAACTATGAAGTAGATGACGATACT

ATTTTAATCACTAACTCTGATATGGGTAAAGGCTATACTAGTAGAGTTTTTAAGGAATTAGGAAAAGCACTT

AAGGTAAAGAAACATGAGCATTTTTGGGATATCTATCATGTtAAAGAAAAGTTAAGTTCATACCTTAGAAAA

TATCCAATTGAATTAACCGATTTTGCTTTAGATGCGGTAAAAAAATATAATTCTGATAAGCTTGAATTAGTT

TTTGATACTGTTGAATCACTGATTTGTGATGAACTTGAAGATCAAGAATTTCAGAAGTTTAAGAAAAAGTA

TTAAATAATTTCAAATATATAAAACCAGCTCATCTTAGAAATCTTTCAAATCGTGGTATTGGTATCATGGAA

TCACAACACAGAAAGATAACGTATAGAATGAAGCGACGTGGCATGTATTGGTCAAAGTGGGGAATCTCCACA

ATGGCAAATATGATTATATTTGAAAGAGCTAACGGTTTACGAGAATTATTTTTCGGTTCTTGGAGAAAGGTA

TABLE 9-continued

Amino acid and encoding DNA sequences of gbs1309 proteins
derived from different strains of S. agalactiae

TACAGTGAGTATAAAGAAGGTTCATTTAGTGCAGGGCGACTTTTTAAAAAGACAGATGAATTATATAAATTT

TCTAAGCCCCTTCTAAAAAATGGCAGAAAATGGAGTATAACAGGAATCAAAACAAAATAG

ORF amino acid sequence (SEQ ID NO: 80):

FSVTYSQSERTVVFSFGEITFSRSRWTNGFETRIPVDEWLGLEKYKRYSIEFLYHVAKLATMMPYCQVCKVI

DSTLQTIITKDCVLKAVKFVEKLLKEKERYRFYLEEPPERKKVKKLYVEGDGVMIKSTDSREERRYLDLTHF

VIHTGSKKVSTKRYELQDKHEILQLNYDKAKYNLLDYIYNNYEVDDDTILITNSDMGKGYTSRVFKELGKAL

KVKKHEHFWDIYHVKEKLSSYLRKYPIELTDFALDAVKKYNSDKLELVFDTVESLICDELEDQEFQKFKKKV

LNNFKYIKPAHLRNLSNRGIGIMESQHRKITYRMKRRGMYWSKWGISTMANMIIFERANGLRELFFGSWRKV

YSEYKEGSFSAGRLFKKTDELYKFSKPLLKNGRKWSITGIKTK

Strain BAA23
ORF DNA sequence (SEQ ID NO: 87):

TTTAGTGTAACCTATTCACAGTCTGAACGTACGGTTGTTTTCTCTTTTGGAGAAATAACATTTAGTAGGAGT

CGCTGGACAAATGGCTTTGAAACTAGAATACCAGTAGATGAGTGGTTAGGTCTTGAAAAATATAAGAGATAT

TCAATAGAATTCTTATATCATGTTGCAAAATTGGCTACAATGATGCCTTATCGTCAAGTTTGCAAAGTAATA

GATAGCACTTTGCAAACAATCATAACAAAAGACTGTGTTTTAAAAGCAGTAAAATTTGTAGAAAAATTGTTA

AAAGAAAAGAACGCTATCGTTTTTATTTGGAAGAGCCACCCGAACGTAAAAAAGTGAAAAAACTGTATGTT

GAGGGTGATGGAGTCATGATTAAAAGCACAGATTCTAGAGAGGAAAGAAGGTATTTAGATTTAACACATTTT

GTTATTCATACAGGCTCAAAAAAAGTTTCTACTAAAAGATATGAATTGCAGGACAAGCACGAAATATTACAG

CTTAATTATGATAAAGCTAAATATAATCTTTTAGATTATATTTATAATAACTATGAAGTAGATGACGATACT

ATTTTAATCACTAACTCTGATATGGGTAAAGGCTATACTAGTAGAGTTTTTAAGGAATTAGGAAAAGCACTT

AAGGTAAAGAAACATGAGCATTTTTGGGATATCTATCATGTTAAAGAAAAGTTAAGTTCATACCTTAGAAAA

TATCCAATTGAATTAACCGATTTTGCTTTAGATGCGGTAAAAAAATATAATTCTGATAAGCTTGAATTAGTT

TTTGATACTGTTGAATCACTGATTTGTGATGAACTTGAAGATCAAGAATTTCAGAAGTTTAAGAAAAAAGTA

TTAAATAATTTCAAATATATAAAACCAGCTCATCTTAGAAATCTTTCAAATCGTGGTATTGGTATCATGGAA

TCACAACACAGAAAGATAACGTATAGAATGAAGCGACGTGGCATGTATTGGTCAAAGTGGGGAATCTCCACA

ATGGCAAATATGATTATACTTGAAAGAGCTAACGGTTTACGAGAATTATTTTTCGGTTCTTGGAGAAAGGTA

TACAGTGAGTATAAAGAAGGTTCATTTAGTGCAGGGCGACTTTTTAAAAAGACAGATGAATTAGATAAATTT

TCTAAGCCCCTTCTAAAAAATGGCAGAAAATGGAGTATAACAGGAATCAAAACAAAATAG

ORF amino acid sequence (SEQ ID NO: 81):

FSVTYSQSERTVVFSFGEITFSRSRWTNGFETRIPVDEWLGLEKYKRYSIEFLYHVAKLATMMPYRQVCKVI

DSTLQTIITKDCVLKAVKFVEKLLKEKERYRFYLEEPPERKKVKKLYVEGDGVMIKSTDSREERRYLDLTHF

VIHTGSKKVSTKRYELQDKHEILQLNYDKAKYNLLDYIYNNYEVDDDTILITNSDMGKGYTSRVFKELGKAL

KVKKHEHFWDIYHVKEKLSSYLRKYPIELTDFALDAVKKYNSDKLELVFDTVESLICDELEDQEFQKFKKKV

LNNFKYIKPAHLRNLSNRGIGIMESQHRKITYRMKRRGMYWSKWGISTMANMIILERANGLRELFFGSWRKV

YSEYKEGSFSAGRLFKKTDELDKFSKPLLKNGRKWSITGIKTK

Strain COH1
ORF DNA sequence (SEQ ID NO: 88):

ATGGAAGTTAAAAAATTCTCGGAAAAAGATTTTGTAAATGAAATAAATAAAATAAAACAGAAACAATTTTTA

AGTCAAATTGAACAGTATGAAAGCTATATCGCTCCTCAAATGAGAACGAAAGGCTATAAGAGGATCAATCAG

TCTGAACGTACGGTTGTTTTCTCTTTTGGAGAAATAACATTTAGTAGGAGTCGCTGGACAAATGGCTTTGAA

TABLE 9-continued

Amino acid and encoding DNA sequences of gbs1309 proteins
derived from different strains of *S. agalactiae*

ACTAGAATACCAGTAGATGAGTGGTTAGGTCTTGAAAAATATAAGAGATATTCAATAGAATTCTTATATCAT

GTTGCAAAATTGGCTACAATGATGCCTTATCGTCAAGTTTGCAAAGTAATAGATAGCACTTTGCAAACAATC

ATAACAAAAGACTGTGTTTTAAAAGCAGTAAAATTTGTAGAAAAATTGTTAAAAGAAAAAGAACGCTATCGT

TTTTATTTGGAAGAGCCACCCGAACGTAAAAAAGTGAAAAAACTGTATGTTGAGGGTGATGGAGTCATGATT

AAAAGCACAGATTCTAGAGAGGAAAGAAGGTATTTAGATTTAACACATTTTGTTATTCATACAGGCTCAAAA

AAAGTTTCTACTAAAAGATATGAATTGCGGGACAAGCACGAAATATTACAGCTTAATTATGATAAAGCTAAA

TATAATCTTTTAGATTATATTTATAATAACTATGAAGTAGATGACGATACTATTTTAATCACTAACTCTGAT

ATGGGTAAAGGCTATACTAGTAGAGTTTTTAAGGAATTAGGAAAAGCACTTAAGGTAAAGAAACATGAGCAT

TTTTGGGATATCTATCATGTTAAAGAAAAGTTAAGTTCATACCTTAGAAAATATCCAATTGAATTAACCGAT

TTTGCTTTAGATGCGGTAAAAAAATATAATTCTGATAAGCTTGAATTAGTTTTTGATACTGTTGAATCACTG

ATTTGTGATGAACTTGAAGATCAAGAATTTCAGAAGTTTAAGAAAAAAGTATTAAATAATTTCAAATATATA

AAACCAGCTCATCTTAGAAATCTTTCAAATCGTGGTATTGGTATCATGGAATCACAACACAGAAAGATAACG

TATAGAATGAAGCGACGTGGCATGTATTGGTCAAAGTGGGGAATCTCCACAATGGCAAATATGATTATACTT

GAAAGAGCTAACGGTTTACGAGAATTATTTTTCGGTTCTTGGAGAAAGGTATACAGTGAGTATAAAGAAGGT

TCATTTAGTGCAGGGCGACTTTTTAAAAAGACAGATGAATTAGATAAATTTTCTAAGCCCCTTCTAAAAAAT

GGCAGAAAATGGAGTATAACAGGAATCAAAACAAAATAG

ORF amino acid sequence (SEQ ID NO: 82):

MEVKKFSEKDFVNEINKIKQKQFLSQIEQYESYIAPQMRTKGYKRINQSERTVVFSFGEITFSRSRWTNGFE

TRIPVDEWLGLEKYKRYSIEFLYHVAKLATMMPYRQVCKVIDSTLQTIITKDCVLKAVKFVEKLLKEKERYR

FYLEEPPERKKVKKLYVEGDGVMIKSTDSREERRYLDLTHFVIHTGSKKVSTKRYELRDKHEILQLNYDKAK

YNLLDYIYNNYEVDDDTILITNSDMGKGYTSRVFKELGKALKVKKHEHFWDIYHVKEKLSSYLRKYPIELTD

FALDAVKKYNSDKLELVFDTVESLICDELEDQEFQKFKKKVLNNFKYIKPAHLRNLSNRGIGIMESQHRKIT

YRMKRRGMYWSKWGISTMANMIILERANGLRELFFGSWRKVYSEYKEGSFSAGRLFKKTDELDKFSKPLLKN

GRKWSITGIKTK

Strain IC105
ORF DNA sequence (SEQ ID NO: 89):

TTTAGTGTAACCTATTCACAGTCTGAACGTACGGTTGTTTTCTCTTTTGGAGAAATAACATTTAGTAGGAGT

CGCTGGACAAATGGCTTTGAAACTAGAATACCAGTAGATGAGTGGTTAGGTCTTGAAAAATATAAGAGATAT

TCAATAGAATTCTTATATCATGTTGCAAAATTGGCTACAATGATGCCTTATCGTCAAGTTTGCAAAGTAATA

GATAGCACTTTGCAAACAATCATAACAAAAGACTGTGTTTTAAAAGCAGTAAAATTTGTAGAAAAATTGTTA

AAAGAAAAAGAACGCTATCGTTTTTATTTGGAAGAGCCACCCGAACGTAAAAAAGTGAAAAAACTGTATGTT

GAGGGTGATGGAGTCATGATTAAAAGCACAGATTCTAGAGAGGAAAGAAGGTATTTAGATTTAACACATTTT

GTTATTCATACAGGCTCAAAAAAAGTTTCTACTAAAAGATATGAATTGCAGGACAAGCACGAAATATTACAG

CTTAATTATGATAAAGCTAAATATAATCTTTTAGATTATATTTATAATAACTATGAAGTAGATGACGATACT

ATTTTAATCACTAACTCTGATATGGGTAAAGGCTATACTAGTAGAGTTTTTAAGGAATTAGGAAAAGCACTT

AAGGTAAAGAAACATGAGCATTTTTGGGATATCTATCATGTTAAAGAAAAGTTAAGTTCATACCTTAGAAAA

TATCCAATTGAATTAACCGATTTTGCTTTAGATGCGGTAAAAAAATATAATTCTGATAAGCTTGAATTAGTT

TTTGATACTGTTGAATCACTGATTTGTGATGAACTTGAAGATCAAGAATTTCAGAAGTTTAAGAAAAAAGTA

TTAAATAATTTCAAATATATAAAACCAGCTCATCTTAGAAATCTTTCAAATCGTGGTATTGGTATCATGGAA

TABLE 9-continued

Amino acid and encoding DNA sequences of gbs1309 proteins
derived from different strains of *S. agalactiae*

TCACAACACAGAAAGATAACGTATAGAATGAAGCGACGTGGCATGTATTGGTCAAAGTGGGGAATCTCCACA

ATGGCAAATATGATTATACTTGAAAGAGCTAACGGTTTACGAGAATTATTTTTCGGTTCTTGGAGAAAGGTA

TACAGTGAGTATAAAGAAGGTTCATTTAGTGCAGGGCGACTTTTTAAAAAGACAGATGAATTAGATAAATTT

TCTAAGCCCCTTCTAAAAAATGGCAGAAAATGGAGTATAACAGGAATCAAAACAAAATAG

ORF amino acid sequence (SEQ ID NO: 83):

FSVTYSQSERTVVFSFGEITFSRSRWTNGFETRIPVDEWLGLEKYKRYSIEFLYHVAKLATMMPYRQVCKVI

DSTLQTIITKDCVLKAVKFVEKLLKEKERYRFYLEEPPERKKVKKLYVEGDGVMIKSTDSREERRYLDLTHF

VIHTGSKKVSTKRYELQDKHEILQLNYDKAKYNLLDYIYNNYEVDDDTILITNSDMGKGYTSRVFKELGKAL

KVKKHEHFWDIYHVKEKLSSYLRKYPIELTDFALDAVKKYNSDKLELVFDTVESLICDELEDQEFQKFKKKV

LNNFKYIKPAHLRNLSNRGIGIMESQHRKITYRMKRRGMYWSKWGISTMANMIILERANGLRELFFGSWRKV

YSEYKEGSFSAGRLFKKTDELDKFSKPLLKNGRKWSITGIKTK

Strain IC458
ORF DNA sequence (SEQ ID NO: 90):

TTTAGTGTAACCTATTCACAGTCTGAACGTACGGTTGTTTTCTCTTTTGGAGAAATAACATTTAGTAGGAGT

CGCTGGACAAATGGCTTTGAAACTAGAATACCAGTAGATGAGTGGTTAGGTCTTGAAAAATATAAGAGATAT

TCAATAGAATTCTTATATCATGTTGCAAAATTGGCTACAATGATGCCTTATCGTCAAGTTTGCAAAGTAATA

GATAGCACTTTGCAAACAATCATAACAAAAGACTGTGTTTTAAAAGCAGTAAAATTTGTAGAAAAATTGTTA

AAAGAAAAAGAACGCTATCGTTTTTATTTGGAAGAGCCACCCGAACGTAAAAAAGTGAAAAAACTGTATGTT

GAGGGTGATGGAGTCATGATTAAAAGCACAGATTCTAGAGAGGAAAGAAGGTATTTAGATTTAACACATTTT

GTTATTCATACAGGCTCAAAAAAAGTTTCTACTAAAAGATATGAATTGCAGGACAAGCACGAAATATTACAG

CTTAATTATGATAAAGCTAAATATAATCTTTTAGATTATATTTATAATAACTATGAAGTAGATGACGATACT

ATTTTAATCACTAACTCTGATATGGGTAAAGGCTATACTAGTAGAGTTTTTAAGGAATTAGGAAAAGCACTT

AAGGTAAAGAAACATGAGCATTTTTGGGATATCTATCATGTTAAAGAAAAGTTAAGTTCATACCTTAGAAAA

TATCCAATTGAATTAACCGATTTTGCTTTAGATGCGGTAAAAAAATATAATTCTGATAAGCTTGAATTAGTT

TTTGATACTGTTGAATCACTGATTTGTGATGAACTTGAAGATCAAGAATTTCAGAAGTTTAAGAAAAAAGTA

TTAAATAATTTCAAATATATAAAACCAGCTCATCTTAGAAATCTTTCAAATCGTGGTATTGGTATCATGGAA

TCACAACACAGAAAGATAACGTATAGAATGAAGCGACGTGGCATGTATTGGTCAAAGTGGGGAATCTCCACA

ATGGCAAATATGATTATACTTGAAAGAGCTAACGGTTTACGAGAATTATTTTTCGGTTCTTGGAGAAAGGTA

TACAGTGAGTATAAAGAAGGTTCATTTAGTGCAGGGCGACTTTTTAAAAAGACAGATGAATTAGATAAATTT

TCTAAGCCCCTTCTAAAAAATGGCAGAAAATGGAGTATAACAGGAATCAAAACAAAATAG

ORF amino acid sequence (SEQ ID NO: 84):

FSVTYSQSERTVVFSFGEITFSRSRWTNGFETRIPVDEWLGLEKYKRYSIEFLYHVAKLATMMPYRQVCKVI

DSTLQTIITKDCVLKAVKFVEKLLKEKERYRFYLEEPPERKKVKKLYVEGDGVMIKSTDSREERRYLDLTHF

VIHTGSKKVSTKRYELQDKHEILQLNYDKAKYNLLDYIYNNYEVDDDTILITNSDMGKGYTSRVFKELGKAL

KVKKHEHFWDIYHVKEKLSSYLRKYPIELTDFALDAVKKYNSDKLELVFDTVESLICDELEDQEFQKFKKKV

LNNFKYIKPAHLRNLSNRGIGIMESQHRKITYRMKRRGMYWSKWGISTMANMIILERANGLRELFFGSWRKV

YSEYKEGSFSAGRLFKKTDELDKFSKPLLKNGRKWSITGIKTK

TABLE 10

Amino acid and encoding DNA sequences of gbs1477 proteins
derived from different strains of *S. agalactiae*

Strain 0176H4A
ORF DNA sequence (SEQ ID NO: 133):

ATGAAAAAAATCAACAAATTTTTTGTGGCGTTCTCAGCGTTGTTACTGATTTTAACGTCATTGCTCTCAGTT

GCACCAGCGTTTGCGGAAAAAGAAAAAACAACTGAGACTGTTACTTTGCATAAAATTTTACAAACTGATACA

AACCTTAAGAATAGTGCTTTCCCTGGTACAAAAGGGCTAGATGGAACTGAATATGACGGGAAAGCTATTGAT

AAATTGGATAGCTACTTTGGCAATGACTCAAAAGATATTGGTGGGGCTTACTTTATATTGGCAAATAGCAAG

GGTGAATATATCAAAGCTAATGATAAAAATAAATTAAAGCCTGAGTTTAGTGGGAACACTCCGAAAACGACC

CTCAATATTAGTGAAGCTGTAGGTGGTTTGACAGAAGAAACGCAGGTATTAAGTTTGAAACCACTGGTTTA

AGAGGGGATTTCCAGATTATTGAATTGAAAGACAAGTCAACTTACAATAATGGTGGGGCCATCTTGGCTGAT

TCAAAAGCGGTTCCAGTGAAAATCACTCTTCCATTGATAAACAAGGATGGTGTTGTTAAAGATGCACACGTC

TATCCAAAGAACACTGAAACAAAACCGCAAATTGACAAGAACTTTGCTGATAAAAATCTTGATTATATTAAC

AACCAAAAAGACAAAGGTACTATATCAGCAACTGTTGGTGATGTTAAAAAATATACTGTTGGGACAAAAATC

CTTAAAGGATCTGACTATAAAAAATTAGTTTGGACCGATAGCATGACGAAAGGATTGACGTTTAACAACGAT

GTTACTGTAACATTGGATGGTGCAAATTTTGAACAATCAAATTACACCTTAGTAGCTGATGACCAAGGTTTC

CGTCTTGTCTTGAATGCAACAGGTCTTTCTAAAGTAGCAGAAGCTGCAAAAACAAAAGATGTTGAAATCAAA

ATCAACTATTCAGCTACAGTAAACGGTTCTACTGTCGTTGAAAAGTCAGAAAATAATGATGTCAAACTAGAT

TATGGTAACAACCCAACAACTGAAAACGAACCACAAACTGGTAATCCAGTTAACAAAGAAATCACAGTTCGA

AAGACTTGGGCAGTGGATGGTAATGAAGTGAATAAGGGAGATGAAAAAGTTGACGCTGTCTTCACGTTGCAA

GTTAAAGATAGTGACAAATGGGTAATGTCGATTCAGCAACAGCAACAGCAGCAACTGACTTCAAATACACT

TTCAAAAACTTGGATAATGCCAAAACTTACCGTGTTGTAGAACGTGTTAGCGGCTACGCTCCAGCCTACGTT

TCATTTGTGGGTGGAGTTGTGACTATTAAGAATAACAAAAACTCAAATGACCCAACTCCAATCAATCCATCA

GAACCAAAAGTTGTGACTTATGGACGTAAATTTGTGAAAACAAATCAAGATGGCTCTGAACGTCTAGCAGGA

GCTACTTTCCTTGTTAAGAACTCACAAAGTCAATACTTGGCACGTAAATCAGGTGTTGCAACTAATGAAGCT

CACAAAGCAGTAACAGATGCTAAAGTACAACTGGATGAAGCTGTTAAAGCTTATAACAAATTGACTAAAGAA

CAACAAGAAAGTCAAGATGGTAAAGCAGCATTGAATCTTATTGATGAAAACAAACAGCTTACAATGAAGCT

TTTGCTAAAGCAAACTACTCATATGAATGGGTTGTAGATAAAAACGCTGCAAACGTTGTTAAATTGATTTCT

AATACAGCTGGTAAATTTGAAATTACAGGTTTGAATGCAGGCGAGTATAGTTTGGAAGAGACTCAAGCACCA

ACAGGTTATGCTAAATTGTCAAGTGATGTATCATTTAAAGTAAATGATACATCGTATAGCGAAGGGGCTTCA

AATGATATTGCATACGATAAAGACTCCGGTAAAACAGATGCACAAAAGTTGTCAACAAAAAAGTAACAATC

CCACAAACAGGTGGTATTGGTACAATTCTTTTCACAATTATTGGTTTAAGCATTATGCTTGGAGCGGTAGTT

ATCATGAAAAGACGTCAATCAGAGGAAGCTTAA

ORF amino acid sequence (SEQ ID NO: 91):

MKKINKFFVAFSALLLILTSLLSVAPAFAEKEKTTETVTLHKILQTDTNLKNSAFPGTKGLDGTEYDGKAID
KLDSYFGNDSKDIGGAYFILANSKGEYIKANDKNKLKPEFSGNTPKTTLNISEAVGGLTEENAGIKFETTGL
RGDFQIIELKDKSTYNNGGAILADSKAVPVKITLPLINKDGVVKDAHVYPKNTETKPQIDKNFADKNLDYIN
NQKDKGTISATVGDVKKYTVGTKILKGSDYKKLVWTDSMTKGLTFNNDVTVTLDGANFEQSNYTLVADDQGF
RLVLNATGLSKVAEAAKTKDVEIKINYSATVNGSTVVEKSENNDVKLDYGNNPTTENEPQTGNPVNKEITVR
KTWAVDGNEVNKGDEKVDAVFTLQVKDSDKWVNVDSATATAATDFKYTFKNLDNAKTYRVVERVSGYAPAYV
SFVGGVVTIKNNKNSNDPTPINPSEPKVVTYGRKFVKTNQDGSERLAGATFLVKNSQSQYLARKSGVATNEA

TABLE 10-continued

Amino acid and encoding DNA sequences of gbs1477 proteins
derived from different strains of *S. agalactiae*

HKAVTDAKVQLDEAVKAYNKLTKEQQESQDGKAALNLIDEKQTAYNEAFAKANYSYEWVVDKNAANVVKLIS

NTAGKFEITGLNAGEYSLEETQAPTGYAKLSSDVSFKVNDTSYSEGASNDIAYDKDSGKTDAQKVVNKKVTI

PQTGGIGTILFTIIGLSIMLGAVVIMKRRQSEEA

Strain 12351
ORF DNA sequence (SEQ ID NO: 134):

ATGAAAAAAATCAACAAATATTTTGCAGTCTTCTCGGCATTGCTACTGACCGTAACATCATTGTTCTCAGTT

GCACCAGTGTTTGCGGAAGAAGCAAAAACTACTGACACAGTGACCTTGCACAAGATTGTCATGCCTCGAACT

GCATTTGACGGTTTTACTGCTGGTACAAAGGGTAAGGATAATACTGACTACGTTGGTAAACAAATCGAAGAC

CTTAAAACTTACTTTGGCTCAGGCGAAGCGAAAGAAATCGCAGGTGCTTACTTTGCTTTCAAAAATGAAGCT

GGTACTAAATACATCACTGAAAATGGTGAAGAAGTTGATACTTTGGATACAACAGATGCCAAAGGTGGTGCT

GTTCTTAAAGGTTTAACAACAGACAATGGTTTCAAATTTAACACTTCTAAATTAACAGGAACTTACCAAATC

GTTGAATTGAAAGAAAAATCTACATACAACAACGATGGTTCTATCTTGGCTGATTCAAAAGCAGTTCCAGTT

AAAATCACTCTTCCATTGGTAAACGACAATGGTGTTGTTAAAGACGCTCACGTTTATCCAAAGAACACTGAA

ACAAAACCACAAGTAGATAAGAACTTCGCAGATAAAGAACTTGATTATGCGAACAACAAAAAAGACAAAGGG

ACTGTCTCAGCATCTGTTGGTGATGTTAAAAAATATCATGTTGGAACAAAAATCCTTAAAGGTTCAGACTAT

AAGAAATTAATCTGGACCGATAGCATGACCAAAGGTTTGACTTTCAACAACGATATTGCTGTAACATTGGAT

GGTGCAACTCTTGATGCTACAAATTACAAACTTGTAGCAGATGACCAAGGTTTCCGCCTTGTCTTGACTGAC

AAAGGTCTTGAAGCAGTGGCAAAAGCCGCAAAAACAAAGATGTTGAAATCAAGATCACTTACTCAGCTACT

TTGAACGGTTCTGCTGTCGTTGAAGTTCTAGAAACCAATGATGTTAAATTGGACTACGGCAACAACCCAACA

ATTGAAAATGAACCAAAAGAAGGTATTCCAGTTGATAAGAAAATCACTGTTAACAAAACATGGGCAGTAGAT

GGCAATGAAGTGAATAAAGCAGATGAAACAGTTGATGCTGTCTTCACCTTGCAAGTTAAAGATGGTGACAAA

TGGGTGAATGTTGATTCAGCTAAAGCAACAGCTGCAACTAGCTTCAAACACACTTTTGAAAACTTGGATAAT

GCTAAAACTTACCGCGTTATCGAACGTGTTAGCGGCTACGCTCCAGAATACGTCTCATTTGTAAATGGCGTT

GTAACCATCAAGAACAACAAAGACTCAAATGAGCCAACTCCAATCAACCCATCAGAACCAAAAGTGGTGACT

TATGGACGTAAATTTGTGAAAACAAATAAAGATGGAAAAGAACGCTTGGCAGGAGCTACCTTCCTTGTTAAG

AAAGATGGCAAGTACTTGGCACGTAAATCAGGTGTTGCAACAGATGCAGAAAAAGCTGCTGTAGATTCAACT

AAATCAGCATTGGATGCTGCTGTTAAAGCTTACAATGATTTGACTAAAGAAAAACAAGAAGGTCAAGATGGT

AAATCAGCATTGGCTACCGTTAGTGAAAAACAAAAAGCTTACATTGATGCCTTTGTTAAAGCTAACTACTCA

TACGAATGGGTTGAAGATAAAAATGCTAAGAATGTTGTTAAATTGATTTCTAACGATAAAGGTCAATTTGAA

ATTACTGGCTTGACTGAAGGTCAATACTCATTGGAAGAAACACAAGCACCAACTGGTTATGCTAAATTATCA

GGTGATGTTTCGTTTAATGTTAATGCTACTTCATACAGTAAAGGTTCTGCTCAAGATATTGAGTATACCCAA

GGTTCTAAAACTAAAGATGCACAACAAGTTATCAATAAGAAGGTTACTATTCCACAAACAGGTGGTATTGGT

ACAATTTTTTTCACAATTATTGGATTAAGTATTATGCTTGGAGCGGTAGTTATCATGAAAAGACGTCAATCA

GAGGAAGTTTAA

ORF amino acid sequence (SEQ ID NO: 92):

MKKINKYFAVFSALLLTVTSLFSVAPVFAEEAKTTDTVTLHKIVMPRTAFDGFTAGTKGKDNTDYVGKQIED

LKTYFGSGEAKEIAGAYFAFKNEAGTKYITENGEEVDTLDTTDAKGGAVLKGLTTDNGFKFNTSKLTGTYQI

VELKEKSTYNNDGSILADSKAVPVKITLPLVNDNGVVKDAHVYPKNTETKPQVDKNFADKELDYANNKKDKG

TVSASVGDVKKYHVGTKILKGSDYKKLIWTDSMTKGLTFNNDIAVTLDGATLDATNYKLVADDQGFRLVLTD

TABLE 10-continued

Amino acid and encoding DNA sequences of gbs1477 proteins
derived from different strains of S. agalactiae

KGLEAVAKAAKTKDVEIKITYSATLNGSAVVEVLETNDVKLDYGNNPTIENEPKEGIPVDKKITVNKTWAVD

GNEVNKADETVDAVFTLQVKDGDKWVNVDSAKATAATSFKHTFENLDNAKTYRVIERVSGYAPEYVSFVNGV

VTIKNNKDSNEPTPINPSEPKVVTYGRKFVKTNKDGKERLAGATFLVKKDGKYLARKSGVATDAEKAAVDST

KSALDAAVKAYNDLTKEKQEGQDGKSALATVSEKQKAYIDAFVKANYSYEWVEDKNAKNVVKLISNDKGQFE

ITGLTEGQYSLEETQAPTGYAKLSGDVSFNVNATSYSKGSAQDIEYTQGSKTKDAQQVINKKVTIPQTGGIG

TIFFTIIGLSIMLGAVVIMKRRQSEEV

Strain 12401
ORF DNA sequence (SEQ ID NO: 135):

ATGAAAAGAATCAACAAATATTTTGCAATGTTCTCGGCATTGTTATTAATTTTAACATCGTTGTTATCGGTA

GCTCCGGTATTTGCTGCTGAGATGGGAAATATCACTAAAACAGTAACCTTACACAAAATTGTTCAAACATCC

GATAATTTGGCTAAGCCAAATTTCCCAGGAATAAATGGATTGAATGGAACGAAGTATATGGGTCAAAAACTT

ACTGACATTTCAGGATATTTTGGGCAAGGTTCTAAAGAAATCGCCGGTGCTTTCTTTGCGGTTATGAATGAA

AGTCAGACAAAATATATCACAGAAAGTGGTACTGAAGTAGAAAGTATCGATGCAGCAGGTGTCCTTAAAGGT

TTGACAACTGAAAACGGCATTACATTTAATACTGCAAACTTAAAAGGAACATACCAAATCGTTGAGTTGCTT

GACAAATCTAATTATAAAAATGGTGACAAAGTTCTTGCTGACTCAAAAGCTGTCCCAGTGAAAATCACTCTT

CCTTTGTATAACGAAGAAGGAATTGTCGTGGACGCTGAAGTGTATCCAAAGAATACAGAAGAAGCACCACAA

ATCGACAAAAACTTTGCTAAAGCAAATAAATTGTTGAATGACAGTGATAATTCAGCTATTGCAGGTGGGGCA

GACTACGACAAATATCAGGCAGAAAAAGCAAAAGCTACTGCTGAAATCGGTCAAGAAATCCCTTACGAAGTT

AAAACAAAAATCCAAAAAGGGTCTAAATACAAAAACCTTGCTTGGGTCGATACCATGTCAAATGGTTTGACA

ATGGGTAACACTGTTAACTTAGAAGCATCGTCAGGCTCTTTTGTAGAAGGTACAGATTACAATGTTAACGT

GATGACCGTGGTTTCACTTTGAAATTCACAGATACAGGTTTGACTAAGCTACAAAAAGAAGCGGAAACACAA

GCTGTTGAATTCACATTGACATATAGCGCAACAGTTAACGGTGCGGCTATTGATGACAAGCCAGAAAGCAAT

GATATCAAACTTCAATACGGTAACAAACCAGGTAAAAAGTAAAAGAAATCCCAGTAACACCGTCAAATGGC

GAAATCACTGTTAGCAAAACTTGGGACAAAGGTTCAGATTTAGAGAATGCGAATGTTGTTTATACCCTTAAA

GATGGTGGAACAGCTGTTGCCTCAGTTTCATTGACAAAAACAACACCAAATGGCGAAATCAACTTAGGTAAT

GGTATTAAATTTACAGTTACTGGAGCGTTTGCTGGTAAATTCAGTGGTCTGACTGATAGTAAAACATACATG

ATCTCAGAACGTATCGCTGGTTATGGTAATACAATCACTACTGGTGCTGGTAGTGCAGCTATCACCAATACT

CCAGATTCAGACAACCCAACACCACTTAATCCAACTGAACCAAAAGTTGTGACACACGGTAAAAAATTCGTC

AAAACAAGTTCGACTGAAACAGAACGCTTGCAAGGTGCACAGTTCGTTGTTAAAGATTCAGCTGGTAAATAC

CTTGCATTGAAATCATCTGCGACAATATCAGCTCAAACAACAGCTTACACAAATGCTAAAACTGCTCTTGAC

GCTAAAATCGCAGCTTACAACAAACTTTCAGCAGACGATCAAAAAGGTACTAAAGGTGAAACAGCTAAAGCA

GAAATCAAAACTGCTCAAGACGCTTACAATGCAGCCTTCATCGTAGCTCGTACAGCTTACGAGTGGGTAACT

AATAAAGAAGATGCTAACGTTGTTAAAGTGACTTCAAACGCTGACGGTCAATTTGAAGTTAGCGGTCTTGCA

ACTGGTGATTATAAACTTGAAGAAACACAAGCTCCAGCTGGTTACGCTAAATTAGCAGGTGATGTTGATTTC

AAAGTTGGAAACAGCTCAAAAGCAGACGACTCAGGTAACATTGATTACACTGCTAGCAGCAATAAAAAAGAC

GCTCAACGCATAGAAAACAAAAAAGTGACTATTCCACAAACAGGTGGTATTGGTACAATTCTTTTCACAATT

ATTGGTTTAAGCATTATGCTTGGAGCGGTAATTATCATGAAAAGACGTCAATCAGAGGAAGCTTAA

TABLE 10-continued

Amino acid and encoding DNA sequences of gbs1477 proteins
derived from different strains of *S. agalactiae*

ORF amino acid sequence (SEQ ID NO: 93):

MKRINKYFAMFSALLLILTSLLSVAPVFAAEMGNITKTVTLHKIVQTSDNLAKPNFPGINGLNGTKYMGQKL

TDISGYFGQGSKEIAGAFFAVMNESQTKYITESGTEVESIDAAGVLKGLTTENGITFNTANLKGTYQIVELL

DKSNYKNGDKVLADSKAVPVKITLPLYNEEGIVVDAEVYPKNTEEAPQIDKNFAKANKLLNDSDNSAIAGGA

DYDKYQAEKAKATAEIGQEIPYEVKTKIQKGSKYKNLAWVDTMSNGLTMGNTVNLEASSGSFVEGTDYNVER

DDRGFTLKFTDTGLTKLQKEAETQAVEFTLTYSATVNGAAIDDKPESNDIKLQYGNKPGKKVKEIPVTPSNG

EITVSKTWDKGSDLENANVVYTLKDGGTAVASVSLTKTTPNGEINLGNGIKFTVTGAFAGKFSGLTDSKTYM

ISERIAGYGNTITTGAGSAAITNTPDSDNPTPLNPTEPKVVTHGKKFVKTSSTETERLQGAQFVVKDSAGKY

LALKSSATISAQTTAYTNAKTALDAKIAAYNKLSADDQKGTKGETAKAEIKTAQDAYNAAFIVARTAYEWVT

NKEDANVVKVTSNADGQFEVSGLATGDYKLEETQAPAGYAKLAGDVDFKVGNSSKADDSGNIDYTASSNKKD

AQRIENKKVTIPQTGGIGTILFTIIGLSIMLGAVIIMKRRQSEEA

Strain 126H4A
ORF DNA sequence (SEQ ID NO: 136):

ATGAAAAAAATCAACAAATATTTTGCAGTCTTCTCGGCCTTGCTACTGACCGTAACATCATTGCTCTCAGTT

GCACCAGCGTTTGCGGACGAAGCAACAACTAATACAGTGACTTTGCACAAGATCTTGCAAACTGAATCAAAT

CTTAATAAAAGTAACTTCCCAGGAACTACAGGCCTTAACGGAGATGACTATAAAGGTGAATCTATTTCTGAC

CTTGCTAATACTTTGGATCAGGTTCTAAAGAAATTGACGGTGCTTTCTTTGCTTTGGCTTTAGAAGAGGAA

AAAGATGGTGTCGTACAATATGTTAAGGCAAAAGCAAATGACAAATTAACACCAGACTTAATTACTAAAGGT

ACACCTGCAACAACAACAAAAGTTGAAGAAGCTGTAGGTGGTTTGACAACTGGTACGGGTATTGTTTTCAAT

ACAGCTGGTTTGAAAGGTAATTTCAAAATTATTGAATTGAAAGACAAATCAACTTACAACAATAATGGTTCC

CTCTTAGCAGCTTCAAAAGCAGTTCCGGTGAAAATCACTCTTCCATTGGTAAGCAAAGATGGTGTTGTTAAA

GATGCACACGTTTATCCAAAGAACACTGAAACAAAACCAGAAGTAGACAAGAACTTCGCTAAAACAAACGAT

TTGACAGCTCTCAAAGACGCTACTCTTCTTAAGGCTGGTGCAGACTACAAAAACTATTCAGCGACTAAAGCT

ACTGTAACAGCTGAAATCGGTAAAGTTATCCCTTACGAAGTTAAAACAAAAGTTCTTAAAGGTTCTAAATAC

GAAAAACTGGTTTGGACCGATACCATGTCAAATGGTTTGACAATGGGTGATGATGTTAACCTTGCAGTTTCA

GGGACTACAACAACTTTCATTAAAGATATAGATTACACTCTTAGCATTGATGACCGTGGTTTCACATTGAAA

TTCAAAGCTACTGGATTGGACAAATTGGAAGAAGCAGCTAAAGCATCTGATGTTGAATTTACATTGACTTAT

AAAGCTACTGTTAATGGCCAAGCAATTATTGACAACCCAGAAGTCAATGACATCAAATTGGACTATGGTAAT

AAACCTGGTACAGATTTATCAGAACAACCTGTGACACCTGAAGATGGTGAAGTTAAAGTCACTAAAACATGG

GCAGCAGGTGCTAATAAAGCAGACGCTAAAGTTGTCTACACACTTAAAAATGCTACTAAACAAGTCGTAGCT

TCTGTCGCATTGACCGCAGCTGATACAAAAGGTACGATTAATCTTGGTAAAGGCATGACCTTTGAAATCACA

GGAGCTTTCTCAGGTACATTCAAAGGCCTTCAAAATAAAGCTTACACTGTTTCTGAACGTGTTGCAGGTTAT

ACTAATGCTATTAATGTTACTGGTAATGCTGTTGCTATCACCAATACACCAGACAGTGACAATCCAACGCCA

CTTAACCCAACTCAACCAAAAGTTGAAACACATGGTAAGAAATTTGTCAAAGTTGGCGATGCAGATGCCCGC

TTAGCTGGTGCACAATTCGTTGTGAAAAATTCAGCTGGTAAATTCCTTGCTCTTAAAGAAGATGCAGCTGTA

TCAGGAGCTCAAACTGAATTGGCAACTGCTAAAACAGACTTGGATAATGCCATCAAAGCTTACAACGGTTTG

ACAAAAGCGCAGCAAGAAGGTGCTGATGGTACATCAGCAAAAGAACTTATCAACACTAAACAGTCAGCTTAC

GACGCAGCCTTCATCAAAGCACGTACAGCTTATATATGGGTAGATGAAAAAACTAAAGCTATTACCTTCACT

TCAAATAATCAAGGTCAATTTGAAGTTACTGGTCTTGAAGTAGGTTCTTACAAACTTGAAGAAACTCTTGCA

TABLE 10-continued

Amino acid and encoding DNA sequences of gbs1477 proteins
derived from different strains of *S. agalactiae*

CCAGCAGGTTATGCTAAATTGTCAGGCGACATTGAGTTTACAGTTGGACACGATTCTTACACAAGTGGTGAC

ATCAAGTACAAGACAGATGATGCTAGCAACAATGCACAAAAAGTTTTCAATAAAAAAGTAACCATCCCACAA

ACAGGTGGTATTGGTACAATTCTTTTCACAATTATTGGTTTAAGCATTATGCTTGGAGCGGTAGTTATCATG

AAAAGACGTCAATCAGAGGAAGCTTAA

ORF amino acid sequence (SEQ ID NO: 94):

MKKINKYFAVFSALLLTVTSLLSVAPAFADEATTNTVTLHKILQTESNLNKSNFPGTTGLNGDDYKGESISD

LAEYFGSGSKEIDGAFFALALEEEKDGVVQYVKAKANDKLTPDLITKGTPATTTKVEEAVGGLTTGTGIVFN

TAGLKGNFKIIELKDKSTYNNNGSLLAASKAVPVKITLPLVSKDGVVKDAHVYPKNTETKPEVDKNFAKTND

LTALKDATLLKAGADYKNYSATKATVTAEIGKVIPYEVKTKVLKGSKYEKLVWTDTMSNGLTMGDDVNLAVS

GTTTTFIKDIDYTLSIDDRGFTLKFKATGLDKLEEAAKASDVEFTLTYKATVNGQAIIDNPEVNDIKLDYGN

KPGTDLSEQPVTPEDGEVKVTKTWAAGANKADAKVVYTLKNATKQVVASVALTAADTKGTINLGKGMTFEIT

GAFSGTFKGLQNKAYTVSERVAGYTNAINVTGNAVAITNTPDSDNPTPLNPTQPKVETHGKKFVKVGDADAR

LAGAQFVVKNSAGKFLALKEDAAVSGAQTELATAKTDLDNAIKAYNGLTKAQQEGADGTSAKELINTKQSAY

DAAFIKARTAYIWVDEKTKAITFTSNNQGQFEVTGLEVGSYKLEETLAPAGYAKLSGDIEFTVGHDSYTSGD

IKYKTDDASNNAQKVFNKKVTIPQTGGIGTILFTIIGLSIMLGAVVIMKRRQSEEA

Strain 49447
ORF DNA sequence (SEQ ID NO: 137):

ATGAAAAAAATCAACAAATTTTTTGTGGCGTTCTCAGCGTTGTTACTGATTTTAACGTCATTGCTCTCAGTT

GCACCAGCGTTTGCGGAAAAAGAAAAAACAACTGAGACTGTTACTTTGCATAAAATTTTACAAACTGATACA

AACCTTAAGAATAGTGCTTTCCCTGGTACAAAAGGGCTAGATGGAACTGAATATGACGGGAAAGCTATTGAT

AAATTGGATAGCTACTTTGGCAATGACTCAAAAGATATTGGTGGGGCTTACTTTATATTGGCAAATAGCAAG

GGTGAATATATCAAAGCTAATGATAAAAATAAATTAAAGCCTGAGTTTAGTGGGAACACTCCGAAAACGACC

CTCAATATTAGTGAAGCTGTAGGTGGTTTGACAGAAGAAAACGCAGGTATTAAGTTTGAAACCACTGGTTTA

AGAGGGGATTTCCAGATTATTGAATTGAAAGACAAGTCAACTTACAATAATGGTGGGGCCATCTTGGCTGAT

TCAAAAGCGGTTCCAGTGAAAATCACTCTTCCATTGATAAACAAGGATGGTGTTGTTAAAGATGCACACGTC

TATCCAAAGAACACTGAAACAAAACCGCAAATTGACAAGAACTTTGCTGATAAAAATCTTGATTATATTAAC

AACCAAAAAGACAAAGGTACTATATCAGCAACTGTTGGTGATGTTAAAAAATATACTGTTGGGACAAAAATC

CTTAAAGGATCTGACTATAAAAAATTAGTTTGGACCGATAGCATGACGAAAGGATTGACGTTTAACAACGAT

GTTACTGTAACATTGGATGGTGCAAATTTTGAACAATCAAATTACACCTTAGTAGCTGATGACCAAGGTTTC

CGTCTTGTCTTGAATGCAACAGGTCTTTCTAAAGTAGCAGAAGCTGCAAAAACAAAAGATGTTGAAATCAAA

ATCAACTATTCAGCTACAGTAAACGGTTCTACTGTCGTTGAAAAGTCAGAAAATAATGATGTCAAACTAGAT

TATGGTAACAACCCAACAACTGAAAACGAACCACAAACTGGTAATCCAGTTAACAAAGAAATCACAGTTCGA

AAGACTTGGGCAGTGGATGGTAATGAAGTGAATAAGGGAGATGAAAAAGTTGACGCTGTCTTCACGTTGCAA

GTTAAAGATAGTGACAAATGGGTGAATGTCGATTCAGCAACAGCAACAGCAGCAACTGACTTCAAATACACT

TTCAAAAACTTGGATAATGCCAAAACTTACCGTGTTGTAGAACGTGTTAGCGGCTACGCTCCAGCCTACGTT

TCATTTGTGGGTGGAGTTGTGACTATTAAGAATAACAAAAACTCAAATGACCCAACTCCAATCAATCCATCA

GAACCAAAAGTTGTGACTTATGGACGTAAATTTGTGAAAACAAATCAAGATGGCTCTGAACGTCTAGCAGGA

GCTACTTTCCTTGTTAAGAACTCACAAAGTCAATACTTGGCACGTAAATCAGGTGTTGCAACTAATGAAGCT

CACAAAGCAGTAACAGATGCTAAAGTACAACTGGATGAAGCTGTTAAAGCTTATAACAAATTGACTAAAGAA

TABLE 10-continued

Amino acid and encoding DNA sequences of gbs1477 proteins
derived from different strains of *S. agalactiae*

CAACAAGAAAGTCAAGATGGTAAAGCAGCATTGAATCTTATTGATGAAAACAAACAGCTTACAATGAAGCT

TTTGCTAAAGCAAACTACTCATATGAATGGGTTGTAGATAAAAACGCTGCAAACGTTGTTAAATTGATTTCT

AATACAGCTGGTAAATTTGAAATTACAGGTTTGAATGCAGGCGAGTATAGTTTGGAAGAGACTCAAGCACCA

ACAGGTTATGCTAAATTGTCAAGTGATGTATCATTTAAAGTAAATGATACATCGTATAGCGAAGGGGCTTCA

AATGATATTGCATACGATAAAGACTCCGGTAAAACAGATGCACAAAAAGTTGTCAACAAAAAAGTAACAATC

CCACAAACAGGTGGTATTGGTACAATTCTTTTCACAATTATTGGTTTAAGCATTATGCTTGGAGCGGTAGTT

ATCATGAAAAGACGTCAATCAGAGGAAGCTTAA

ORF amino acid sequence (SEQ ID NO: 95):

MKKINKFFVAFSALLLILTSLLSVAPAFAEKEKTTETVTLHKILQTDTNLKNSAFPGTKGLDGTEYDGKAID

KLDSYFGNDSKDIGGAYFILANSKGEYIKANDKNKLKPEFSGNTPKTTLNISEAVGGLTEENAGIKFETTGL

RGDFQIIELKDKSTYNNGGAILADSKAVPVKITLPLINKDGVVKDAHVYPKNTETKPQIDKNFADKNLDYIN

NQKDKGTISATVGDVKKYTVGTKILKGSDYKKLVWTDSMTKGLTFNNDVTVTLDGANFEQSNYTLVADDQGF

RLVLNATGLSKVAEAAKTKDVEIKINYSATVNGSTVVEKSENNDVKLDYGNNPTTENEPQTGNPVNKEITVR

KTWAVDGNEVNKGDEKVDAVFTLQVKDSDKWVNVDSATATAATDFKYTFKNLDNAKTYRVVERVSGYAPAYV

SFVGGVVTIKNNKNSNDPTPINPSEPKVVTYGRKFVKTNQDGSERLAGATFLVKNSQSQYLARKSGVATNEA

HKAVTDAKVQLDEAVKAYNKLTKEQQESQDGKAALNLIDEKQTAYNEAFAKANYSYEWVVDKNAANVVKLIS

NTAGKFEITGLNAGEYSLEETQAPTGYAKLSSDVSFKVNDTSYSEGASNDIAYDKDSGKTDAQKVVNKKVTI

PQTGGIGTILFTIIGLSIMLGAVVIMKRRQSEEA

Strain 5095S2
ORF DNA sequence (SEQ ID NO: 138):

ATGAAAAGAATCAACAAATATTTTGCAATGTTCTCGGCATTGTTATTAATTTTAACATCGTTGTTATCGGTA

GCTCCGGTATTTGCTGCTGAGATGGGAAATATCACTAAAACAGTAACCTTACACAAAATTGTTCAAACATCC

GATAATTTGGCTAAGCCAAATTTCCCAGGAATAAATGGATTGAATGGAACGAAGTATATGGGTCAAAAACTT

ACTGACATTTCAGGATATTTTGGGCAAGGTTCTAAAGAAATCGCCGGTGCTTTCTTTGCGGTTATGAATGAA

AGTCAGACAAAATATATCACAGAAAGTGGTACTGAAGTAGAAAGTATCGATGCAGCAGGTGTCCTTAAAGGT

TTGACAACTGAAAACGGCATTACATTTAATACTGCAAACTTAAAAGGAACATACCAAATCGTTGAGTTGCTT

GACAAATCTAATTATAAAAATGGTGACAAAGTTCTTGCTGACTCAAAAGCTGTCCCAGTGAAAATCACTCTT

CCTTTGTATAACGAAGAAGGAATTATCGTGGACGCTGAAGTGTATCCAAAGAATACAGAAGAAGCACCACAA

ATCGACAAAACTTTGCTAAAGCAAATAAATTGTTGAATGACAGTGATAATTCAGCTATTGCAGGTGGGGCA

GACTACGACAAATATCAGGCAGAAAAAGCAAAAGCTACTGCTGAAATCGGTCAAGAAATCCCTTACGAAGTT

AAAACAAAAATCCAAAAAGGGTCTAAATACAAAAACCTTGCTTGGGTCGATACCATGTCAAATGGTTTGACA

ATGGGTAACACTGTTAACTTAGAAGCATCGTCAGGCTCTTTTGTAGAAGGTACAGATTACAATGTTGAACGT

GATGACCGTGGTTTCACTTTGAAATTCACAGATACAGGTTTGACTAAGCTACAAAAAGAAGCGGAAACACAC

GCTGTTGAATTCACATTGACATATAGCGCAACAGTTAACGGTGCGGCTATTGATGACAAGCCAGAAAGCAAT

GATATCAAACTTCAATACGGTAACAAACCAGGTAAAAAAGTAAAAGAAATCCCAGTAACACCGTCAAATGGC

GAAATCACTGTTAGCAAAACTTGGGACAAAGGTTCAGATTTAGAGAATGCGAATGTTGTTTATACCCTTAAA

GATGGTGGAACAGCTGTTGCCTCAGTTTCATTGACAAAAACAACACCCAAATGGCGAAATCAACTTAGGTAAT

GGTATTAAATTTACAGTTACTGGAGCGTTTGCTGGTAAATTCAGTGGTCTGACTGATAGTAAAACATACATG

ATCTCAGAACGTATCGCTGGTTATGGTAATACAATCACTACTGGTGCTGGTAGTGCAGCTATCACCAATACT

TABLE 10-continued

Amino acid and encoding DNA sequences of gbs1477 proteins
derived from different strains of *S. agalactiae*

CCAGATTCAGACAACCCAACACCACTTAATCCAACTGAACCAAAAGTTGTGACACACGGTAAAAAATTCGTC

AAAACAAGTTCGACTGAAACAGAACGCTTGCAAGGTGCACAGTTCGTTGTTAAAGATTCAGCTGGTAAATAC

CTTGCATTGAAATCATCTGCGACAATATCAGCTCAAACAACAGCTTACACAAATGCTAAAACTGCTCTTGAC

GCTAAAATCGCAGCTTACAACAAACTTTCAGCAGACGATCAAAAAGGTACTAAAGGTGAAACAGCTAAAGCA

GAAATCAAAACTGCTCAAGACGCTTACAATGCAGCCTTCATCGTAGCTCGTACAGCTTACGAGTGGGTAACT

AATAAAGAAGATGCTAACGTTGTTAAAGTGACTTCAAACGCTGACGGTCAATTTGAAGTTAGCGGTCTTGCA

ACTGGTGATTATAAACTTGAAGAAACACAAGCTCCAGCTGGTTACGCTAAATTAGCAGGTGATGTTGATTTC

AAAGTTGGAAACAGCTCAAAAGCAGACGACTCAGGTAACATTGATTACACTGCTAGCAGCAATAAAAAAGAC

GCTCAACGCATAGAAAACAAAAAGTGACTATTCCACAAACAGGTGGTATTGGTACAATTCTTTTCACAATT

ATTGGTTTAAGCATTATGCTTGGAGCGGTAATTATCATGAAAAGACGTCAATCAGAGGAAGCTTAA

ORF amino acid sequence (SEQ ID NO: 96):

MKRINKYFAMFSALLLILTSLLSVAPVFAAEMGNITKTVTLHKIVQTSDNLAKPNFPGINGLNGTKYMGQKL

TDISGYFGQGSKEIAGAFFAVMNESQTKYITESGTEVESIDAAGVLKGLTTENGITFNTANLKGTYQIVELL

DKSNYKNGDKVLADSKAVPVKITLPLYNEEGIIVDAEVYPKNTEEAPQIDKNFAKANKLLNDSDNSAIAGGA

DYDKYQAEKAKATAEIGQEIPYEVKTKIQKGSKYKNLAWVDTMSNGLTMGNTVNLEASSGSFVEGTDYNVER

DDRGFTLKFTDTGLTKLQKEAETHAVEFTLTYSATVNGAAIDDKPESNDIKLQYGNKPGKKVKEIPVTPSNG

EITVSKTWDKGSDLENANVVYTLKDGGTAVASVSLTKTTPNGEINLGNGIKFTVTGAFAGKFSGLTDSKTYM

ISERIAGYGNTITTGAGSAAITNTPDSDNPTPLNPTEPKVVTHGKKFVKTSSTETERLQGAQFVVKDSAGKY

LALKSSATISAQTTAYTNAKTALDAKIAAYNKLSADDQKGTKGETAKAEIKTAQDAYNAAFIVARTAYEWVT

NKEDANVVKVTSNADGQFEVSGLATGDYKLEETQAPAGYAKLAGDVDFKVGNSSKADDSGNIDYTASSNKKD

AQRIENKKVTIPQTGGIGTILFTIIGLSIMLGAVIIMKRRQSEEA

Strain 6313
ORF DNA sequence (SEQ ID NO: 139):

ATGAAAAAAATCAACAAATGTCTTACAGTGTTCTCGACACTGCTATTGATCTTAACGTCACTATTCTCAGTT

GCACCAGCGTTTGCGGACGACGTAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATTAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACACTGGTTTTGCTTTTAACACTGCTAAGTTAAAAGGAACTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

AAAGATTTTCCTGTTTTAAACTACAAACTCGTAACAGATGACCAAGGTTTCCGTCTTGCCTTGAATGCAACA

GGTCTTGCAGCAGTAGCAGCTGCTGCAAAAGACAAAGATGTTGAAATCAAGATCACTTACTCAGCTACGGTG

AACGGCTCCACTACTGTTGAAGTTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGTTAATGTTGCAGTTAAAGCTATCTTTACCTTGCAAGAAAACAAACGGATGGTACATGG

TABLE 10-continued

Amino acid and encoding DNA sequences of gbs1477 proteins
derived from different strains of S. agalactiae

```
GTGAACGTTGCTTCACACGAAGCAACAAAACCATCACGCTTTGAACATACTTTCACAGGTTTGGATAATACT

AAAACTTACCGCGTTGTCGAACGTGTTAGCGGCTACACTCCAGAATATGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTTGTTAAGAAA

GAAGGAAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATAGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGA

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTGTCATGAAAAAACGTCAATCAGAG

GAAGCTTAA
```

ORF amino acid sequence (SEQ ID NO: 97):

```
MKKINKCLTVFSTLLLILTSLFSVAPAFADDVTTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDTGFAFNTAKLKGTYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGKDFPVLNYKLVTDDQGFRLALNAT

GLAAVAAAKDKDVEIKITYSATVNGSTTVEVPETNDVKLDYGNNPTEESEPQEGTPANQEIKVIKDWAVDG

TITDVNVAVKAIFTLQEKQTDGTWVNVASHEATKPSRFEHTFTGLDNTKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYSLEETQAPAGYATLSGDVNFEVTATSYSKGATTDIAYDKGSVKKDAQQVQNKKVTIPQTGGIGT

ILFTIIGLSIMLGAVVVMKKRQSEEA
```

Strain BAA23
ORF DNA sequence (SEQ ID NO: 140):

```
ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG
```

TABLE 10-continued

Amino acid and encoding DNA sequences of gbs1477 proteins
derived from different strains of *S. agalactiae*

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 98):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain BAA611
ORF DNA sequence (SEQ ID NO: 141):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAGGTGTT

GTCTCAGCGACAGTTGGTGACAAAAAAGAATACATAGTTGGAACAAAAATTCTTAAAGGCTCAGACTATAAG

TABLE 10-continued

Amino acid and encoding DNA sequences of gbs1477 proteins derived from different strains of *S. agalactiae*

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 99):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain C388/90
ORF DNA sequence (SEQ ID NO: 142):

ATGAAAAAAATCAACAAATATTTTGCAGTCTTCTCGGCATTGCTACTGACCGTAACATCATTGTTCTCAGTT

GCACCAGTGTTTGCGGAAGAAGCAAAAACTACTGACACAGTGACCTTGCACAAGATTGTCATGCCTCGAACT

GCATTTGACGGTTTTACTGCTGGTACAAAGGGTAAGGATAATACTGACTACGTTGGTAAACAAATCGAAGAC

CTTAAAACTTACTTTGGCTCAGGCGAAGCGAAAGAAATCGCAGGTGCTTACTTTGCTTTCAAAAATGAAGCT

GGTACTAAATACATCACTGAAAATGGTGAAGAAGTTGATACTTTGGATACAACAGATGCCAAAGGTGGTGCT

GTTCTTAAAGGTTTAACAACAGACAATGGTTTCAAATTTAACACTTCTAAATTAACAGGAACTTACCAAATC

GTTGAATTGAAAGAAAAATCTACATACAACAACGATGGTTCTATCTTGGCTGATTCAAAAGCAGTTCCAGTT

TABLE 10-continued

Amino acid and encoding DNA sequences of gbs1477 proteins
derived from different strains of *S. agalactiae*

AAAATCACTCTTCCATTGGTAAACGACAATGGTGTTGTTAAAGACGCTCACGTTTATCCAAAGAACACTGAA

ACAAAACCACAAGTAGATAAGAACTTCGCAGATAAAGAACTTGATTATGCGAACAACAAAAAAGACAAAGGG

ACTGTCTCAGCATCTGTTGGTGATGTTAAAAAATATCATGTTGGAACAAAAATCCTTAAAGGTTCAGACTAT

AAGAAATTAATCTGGACCGATAGCATGACCAAAGGTTTGACTTTCAACAACGATATTGCTGTAACATTGGAT

GGTGCAACTCTTGATGCTACAAATTACAAACTTGTAGCAGATGACCAAGGTTTCCGCCTTGTCTTGACTGAC

AAAGGTCTTGAAGCAGTGGCAAAAGCCGCAAAAACAAAAGATGTTGAAATCAAGATCACTTACTCAGCTACT

TTGAACGGTTCTGCTGTCGTTGAAGTTCTAGAAACCAATGATGTTAAATTGGACTACGGCAACAACCCAACA

ATTGAAAATGAACCAAAAGAAGGTATTCCAGTTGATAAGAAAATCACTGTTAACAAAACATGGGCAGTAGAT

GGCAATGAAGTGAATAAAGCAGATGAAACAGTTGATGCTGTCTTCACCTTGCAAGTTAAAGATGGTGACAAA

TGGGTGAATGTTGATTCAGCTAAAGCAACAGCTGCAACTAGCTTCAAACACACTTTTGAAAACTTGGATAAT

GCTAAAACTTACCGCGTTATCGAACGTGTTAGCGGCTACGCTCCAGAATACGTCTCATTTGTAAATGGCGTT

GTAACCATCAAGAACAACAAAGACTCAAATGAGCCAACTCCAATCAACCCATCAGAACCAAAAGTGGTGACT

TATGGACGTAAATTTGTGAAAACAAATAAAGATGGAAAAGAACGCTTGGCAGGAGCTACCTTCCTTGTTAAG

AAAGATGGCAAGTACTTGGCACGTAAATCAGGTGTTGCAACAGATGCAGAAAAAGCTGCTGTAGATTCAACT

AAATCAGCATTGGATGCTGCTGTTAAAGCTTACAATGATTTGACTAAAGAAAAACAAGAAGGTCAAGATGGT

AAATCAGCATTGGCTACCGTTAGTGAAAAACAAAAAGCTTACAATGATGCCTTTGTTAAAGCTAACTACTCA

TACGAATGGGTTGAAGATAAAAATGCTAAGAATGTTGTTAAATTGATTTCTAACGATAAAGGTCAATTTGAA

ATTACTGGCTTGACTGAAGGTCAATACTCATTGGAAGAAACACAAGCACCAACTGGTTATGCTAAATTATCA

GGTGATGTTTCGTTTAATGTTAATGCTACTTCATACAGTAAAGGTTCTGCTCAAGATATTGAGTATACCCAA

GGTTCTAAAACTAAAGATGCACAACAAGTTATCAATAAGAAGGTTACTATTCCACAAACAGGTGGTATTGGT

ACAATTTTTTTCACAATTATTGGATTAAGTATTATGCTTGGAGCGGTAGTTATCATGAAAAGACGTCAATCA

GAGGAAGTTTAA

ORF amino acid sequence (SEQ ID NO: 100):

MKKINKYFAVFSALLLTVTSLFSVAPVFAEEAKTTDTVTLHKIVMPRTAFDGFTAGTKGKDNTDYVGKQIED
LKTYFGSGEAKEIAGAYFAFKNEAGTKYITENGEEVDTLDTTDAKGGAVLKGLTTDNGFKFNTSKLTGTYQI
VELKEKSTYNNDGSILADSKAVPVKITLPLVNDNGVVKDAHVYPKNTETKPQVDKNFADKELDYANNKKDKG
TVSASVGDVKKYHVGTKILKGSDYKKLIWTDSMTKGLTFNNDIAVTLDGATLDATNYKLVADDQGFRLVLTD
KGLEAVAKAAKTKDVEIKITYSATLNGSAVVEVLETNDVKLDYGNNPTIENEPKEGIPVDKKITVNKTWAVD
GNEVNKADETVDAVFTLQVKDGDKWVNVDSAKATAATSFKHTFENLDNAKTYRVIERVSGYAPEYVSFVNGV
VTIKNNKDSNEPTPINPSEPKVVTYGRKFVKTNKDGKERLAGATFLVKKDGKYLARKSGVATDAEKAAVDST
KSALDAAVKAYNDLTKEKQEGQDGKSALATVSEKQKAYNDAFVKANYSYEWVEDKNAKNVVKLISNDKGQFE
ITGLTEGQYSLEETQAPTGYAKLSGDVSFNVNATSYSKGSAQDIEYTQGSKTKDAQQVINKKVTIPQTGGIG
TIFFTIIGLSIMLGAVVIMKRRQSEEV

Strain IC97
ORF DNA sequence (SEQ ID NO: 143):

ATGAAAAGAATCAACAAATATTTTGCAATGTTCTCGGCATTGTTATTAATTTTAACATCGTTGTTATCGGTA

GCTCCGGTATTTGCTGCTGAGATGGGAAATATCACTAAAACAGTAACCTTACACAAAATTGTTCAAACATCC

GATAATTTGGCTAAGCCAAATTTCCCAGGAATAAATGGATTGAATGGAACGAAGTATATGGGTCAAAAACTT

ACTGACATTTCAGGATATTTTGGGCAAGGTTCTAAAGAAATCGCCGGTGCTTTCTTTGCGGTTATGAATGAA

TABLE 10-continued

Amino acid and encoding DNA sequences of gbs1477 proteins
derived from different strains of S. agalactiae

AGTCAGACAAAATATATCACAGAAAGTGGTACTGAAGTAGAAAGTATCGATGCAGCAGGTGTCCTTAAAGGT

TTGACAACTGAAAACGGCATTACATTTAATACTGCAAACTTAAAAGGAACATACCAAATCGTTGAGTTGCTT

GACAAATCTAATTATAAAAATGGTGACAAAGTTCTTGCTGACTCAAAAGCTGTCCCAGTGAAAATCACTCTT

CCTTTGTATAACGAAGAAGGAATTGTCGTGGACGCTGAAGTGTATCCAAAGAATACAGAAGAAGCACCACAA

ATCGACAAAAACTTTGCTAAAGCAAATAAATTGTTGAATGACAGTGATAATTCAGCTATTGCAGGTGGGGCA

GACTACGACAAATATCAGGCAGAAAAAGCAAAAGCTACTGCTGAAATCGGTCAAGAAATCCCTTACGAAGTT

AAAACAAAAATCCAAAAGGGTCTAAATACAAAAACCTTGCTTGGGTCGATACCATGTCAAATGGTTTGACA

ATGGGTAACACTGTTAACTTAGAAGCATCGTCAGGCTCTTTTGTAGAAGGTACAGATTACAATGTTGAACGT

GATGACCGTGGTTTCACTTTGAAATTCACAGATACAGGTTTGACTAAGCTACAAAAAGAAGCGGAAACACAA

GCTGTTGAATTCACATTGACATATAGCGCAACAGTTAACGGTGCGGCTATTGATGACAAGCCAGAAAGCAAT

GATATCAAACTTCAATACGGTAACAAACCAGGTAAAAAAGTAAAAGAAATCCCAGTAACACCGTCAAATGGC

GAAATCACTGTTAGCAAAACTTGGGACAAAGGTTCAGATTTAGAGAATGCGAATGTTGTTTATACCCTTAAA

GATGGTGGAACAGCTGTTGCCTCAGTTTCATTGACAAAAACAACACCAAATGGCGAAATCAACTTAGGTAAT

GGTATTAAATTTACAGTTACTGGAGCGTTTGCTGGTAAATTCAGTGGTCTGACTGATAGTAAAACATACATG

ATCTCAGAACGTATCGCTGGTTATGGTAATACAATCACTACTGGTGCTGGTAGTGCAGCTATCACCAATACT

CCAGATTCAGACAACCCAACACCACTTAATCCAACTGAACCAAAAGTTGTGACACACGGTAAAAAATTCGTC

AAAACAAGTTCGACTGAAACAGAACGCTTGCAAGGTGCACAGTTCGTTGTTAAAGATTCAGCTGGTAAATAC

CTTGCATTGAAATCATCTGCGACAATATCAGCTCAAACAACAGCTTACACAAATGCTAAAACTGCTCTTGAC

GCTAAAATCGCAGCTTACAACAAACTTTCAGCAGACGATCAAAAAGGTACTAAAGGTGAAACAGCTAAAGCA

GAAATCAAAACTGCTCAAGACGCTTACAATGCAGCCTTCATCGTAGCTCGTACAGCTTACGAGTGGGTAACT

AATAAAGAAGATGCTAACGTTGTTAAAGTGACTTCAAACGCTGACGGTCAATTTGAAGTTAGCGGTCTTGCA

ACTGGTGATTATAAACTTGAAGAAACACAAGCTCCAGCTGGTTACGCTAAATTAGCAGGTGATGTTGATTTC

AAAGTTGGAAACAGCTCAAAAGCAGACGACTCAGGTAACATTGATTACACTGCTAGCAGCAATAAAAAAGAC

GCTCAACGCATAGAAAACAAAAAAGTGACTATTCCACAAACAGGTGGTATTGGTACAATTCTTTTCACAATT

ATTGGTTTAAGCATTATGCTTGGAGCGGTAATTATCATGAAAAGACGTCAATCAGAGGAAGCTTAA

ORF amino acid sequence (SEQ ID NO: 101):

MKRINKYFAMFSALLLILTSLLSVAPVFAAEMGNITKTVTLHKIVQTSDNLAKPNFPGINGLNGTKYMGQKL

TDISGYFGQGSKEIAGAFFAVMNESQTKYITESGTEVESIDAAGVLKGLTTENGITFNTANLKGTYQIVELL

DKSNYKNGDKVLADSKAVPVKITLPLYNEEGIVVDAEVYPKNTEEAPQIDKNFAKANKLLNDSDNSAIAGGA

DYDKYQAEKAKATAEIGQEIPYEVKTKIQKGSKYKNLAWVDTMSNGLTMGNTVNLEASSGSFVEGTDYNVER

DDRGFTLKFTDTGLTKLQKEAETQAVEFTLTYSATVNGAAIDDKPESNDIKLQYGNKPGKKVKEIPVTPSNG

EITVSKTWDKGSDLENANVVYTLKDGGTAVASVSLTKTTPNGEINLGNGIKFTVTGAFAGKFSGLTDSKTYM

ISERIAGYGNTITTGAGSAAITNTPDSDNPTPLNPTEPKVVTHGKKFVKTSSTETERLQGAQFVVKDSAGKY

LALKSSATISAQTTAYTNAKTALDAKIAAYNKLSADDQKGTKGETAKAEIKTAQDAYNAAFIVARTAYEWVT

NKEDANVVKVTSNADGQFEVSGLATGDYKLEETQAPAGYAKLAGDVDFKVGNSSKADDSGNIDYTASSNKKD

AQRIENKKVTIPQTGGIGTILFTIIGLSIMLGAVIIMKRRQSEEA

TABLE 10-continued

Amino acid and encoding DNA sequences of gbs1477 proteins
derived from different strains of *S. agalactiae*

Strain IC98
ORF DNA sequence (SEQ ID NO: 144):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 102):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

TABLE 10-continued

Amino acid and encoding DNA sequences of gbs1477 proteins
derived from different strains of *S. agalactiae*

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC105
ORF DNA sequence (SEQ ID NO: 145):

ATGAAAAGAATCAACAAATATTTTGCAATGTTCTCGGCATTGTTATTAATTTTAACATCGTTGTTATCGGTA

GCTCCGGTATTTGCTGCTGAGATGGGAAATATCACTAAAACAGTAACCTTACACAAAATTGTTCAAACATCC

GATAATTTGGCTAAGCCAAATTTCCCAGGAATAAATGGATTGAATGGAACGAAGTATATGGGTCAAAAACTT

ACTGACATTTCAGGATATTTTGGGCAAGGTTCTAAAGAAATCGCCGGTGCTTTCTTTGCGGTTATGAATGAA

AGTCAGACAAAATATATCACAGAAAGTGGTACTGAAGTAGAAAGTATCGATGCAGCAGGTGTCCTTAAAGGT

TTGACAACTGAAAACGGCATTACATTTAATACTGCAAACTTAAAAGGAACATACCAAATCGTTGAGTTGCTT

GACAAATCTAATTATAAAAATGGTGACAAAGTTCTTGCTGACTCAAAAGCTGTCCCAGTGAAAATCACTCTT

CCTTTGTATAACGAAGAAGGAATTGTCGTGGACGCTGAAGTGTATCCAAAGAATACAGAAGAAGCACCACAA

ATCGACAAAAACTTTGCTAAAGCAAATAAATTGTTGAATGACAGTGATAATTCAGCTATTGCAGGTGGGGCA

GACTACGACAAATATCAGGCAGAAAAAGCAAAAGCTACTGCTGAAATCGGTCAAGAAATCCCTTACGAAGTT

AAAACAAAAATCCAAAAGGGTCTAAATACAAAAACCTTGCTTGGGTCGATACCATGTCAAATGGTTTGACA

ATGGGTAACACTGTTAACTTAGAAGCATCGTCAGGCTCTTTTGTAGAAGGTACAGATTACAATGTTGAACGT

GATGACCGTGGTTTCACTTTGAAATTCACAGATACAGGTTTGACTAAGCTACAAAAAGAAGCGGAAACACAC

GCTGTTGAATTCACATTGACATATAGCGCAACAGTTAACGGTGCGGCTATTGATGACAAGCCAGAAAGCAAT

GATATCAAACTTCAATACGGTAACAAACCAGGTAAAAAAGTAAAAGAAATCCCAGTAACACCGTCAAATGGC

GAAATCACTGTTAGCAAAACTTGGGACAAAGGTTCAGATTTAGAGAATGCGAATGTTGTTTATACCCTTAAA

GATGGTGGAACAGCTGTTGCCTCAGTTTCATTGACAAAAACAACACCAAATGGCGAAATCAACTTAGGTAAT

GGTATTAAATTTACAGTTACTGGAGCGTTTGCTGGTAAATTCAGTGGTCTGACTGATAGTAAAACATACATG

ATCTCAGAACGTATCGCTGGTTATGGTAATACAATCACTACTGGTGCTGGTAGTGCAGCTATCACCAATACT

CCAGATTCAGACAACCCAACACCACTTAATCCAACTGAACCAAAAGTTGTGACACACGGTAAAAAATTCGTC

AAAACAAGTTCGACTGAAACAGAACGCTTGCAAGGTGCACAGTTCGTTGTTAAAGATTCAGCTGGTAAATAC

CTTGCATTGAAATCATCTGCGACAATATCAGCTCAAACAACAGCTTACACAAATGCTAAAACTGCTCTTGAC

GCTAAAATCGCAGCTTACAACAAACTTTCAGCAGACGATCAAAAAGGTACTAAAGGTGAAACAGCTAAAGCA

GAAATCAAAACTGCTCAAGACGCTTACAATGCAGCCTTCATCGTAGCTCGTACAGCTTACGAGTGGGTAACT

AATAAAGAAGATGCTAACGTTGTTAAAGTGACTTCAAACGCTGACGGTCAATTTGAAGTTAGCGGTCTTGCA

ACTGGTGATTATAAACTTGAAGAAACACAAGCTCCAGCTGGTTACGCTAAATTAGCAGGTGATGTTGATTTC

AAAGTTGGAAACAGCTCAAAAGCAGACGACTCAGGTAACATTGATTACACTGCTAGCAGCAATAAAAAAGAC

GCTCAACGCATAGAAAACAAAAAAGTGACTATTCCACAAACAGGTGGTATTGGTACAATTCTTTTCACAATT

ATTGGTTTAAGCATTATGCTTGGAGCGGTAATTATCATGAAAAGACGTCAATCAGAGGAAGCTTAA

ORF amino acid sequence (SEQ ID NO: 103):

MKRINKYFAMFSALLLILTSLLSVAPVFAAEMGNITKTVTLHKIVQTSDNLAKPNFPGINGLNGTKYMGQKL

TDISGYFGQGSKEIAGAFFAVMNESQTKYITESGTEVESIDAAGVLKGLTTENGITFNTANLKGTYQIVELL

DKSNYKNGDKVLADSKAVPVKITLPLYNEEGIVVDAEVYPKNTEEAPQIDKNFAKANKLLNDSDNSAIAGGA

DYDKYQAEKAKATAEIGQEIPYEVKTKIQKGSKYKNLAWVDTMSNGLTMGNTVNLEASSGSFVEGTDYNVER

TABLE 10-continued

Amino acid and encoding DNA sequences of gbs1477 proteins
derived from different strains of *S. agalactiae*

DDRGFTLKFTDTGLTKLQKEAETHAVEFTLTYSATVNGAAIDDKPESNDIKLQYGNKPGKKVKEIPVTPSNG

EITVSKTWDKGSDLENANVVYTLKDGGTAVASVSLTKTTPNGEINLGNGIKFTVTGAFAGKFSGLTDSKTYM

ISERIAGYGNTITTGAGSAAITNTPDSDNPTPLNPTEPKVVTHGKKFVKTSSTETERLQGAQFVVKDSAGKY

LALKSSATISAQTTAYTNAKTALDAKIAAYNKLSADDQKGTKGETAKAEIKTAQDAYNAAFIVARTAYEWVT

NKEDANVVKVTSNADGQFEVSGLATGDYKLEETQAPAGYAKLAGDVDFKVGNSSKADDSGNIDYTASSNKKD

AQRIENKKVTIPQTGGIGTILFTIIGLSIMLGAVIIMKRRQSEEA

Strain IC216
ORF DNA sequence (SEQ ID NO: 146):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGTAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

TABLE 10-continued

Amino acid and encoding DNA sequences of gbs1477 proteins
derived from different strains of S. agalactiae ORF amino acid sequence (SEQ ID NO: 104):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVVTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC245
ORF DNA sequence (SEQ ID NO: 147):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TABLE 10-continued

Amino acid and encoding DNA sequences of gbs1477 proteins
derived from different strains of S. agalactiae

TCTGTAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 105):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC250
ORF DNA sequence (SEQ ID NO: 148):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

TABLE 10-continued

Amino acid and encoding DNA sequences of gbs1477 proteins
derived from different strains of *S. agalactiae*

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 106):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC251
ORF DNA sequence (SEQ ID NO: 149):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

TABLE 10-continued

Amino acid and encoding DNA sequences of gbs1477 proteins
derived from different strains of *S. agalactiae*

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 107):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYOIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC252
ORF DNA sequence (SEQ ID NO: 150):

ATGAAAAAAATCAACAAATATTTTGCAGTCTTCTCGGCATTGCTACTGACCGTAACATCATTGTTCTCAGTT

GCACCAGTGTTTGCGGAAGAAGCAAAAACTACTGACACAGTGACCTTGCACAAGATTGTCATGCCTCGAACT

GCATTTGACGGTTTTACTGCTGGTACAAAGGGTAAGGATAATACTGACTACGTTGGTAAACAAATCGAAGAC

CTTAAAACTTACTTTGGCTCAGGCGAAGCGAAAGAAATCGCAGGTGCTTACTTTGCTTTCAAAAATGAAGCT

GGTACTAAATACATCACTGAAAATGGTGAAGAAGTTGATACTTTGGATACAACAGATGCCAAAGGTGGTGCT

GTTCTTAAAGGTTTAACAACAGACAATGGTTTCAAATTTAACACTTCTAAATTAACAGGAACTTACCAAATC

GTTGAATTGAAAGAAAATCTACATACAACAACGATGGTTCTATCTTGGCTGATTCAAAAGCAGTTCCAGTT

AAAATCACTCTTCCATTGGTAAACGACAATGGTGTTGTTAAAGACGCTCACGTTTATCCAAAGAACACTGAA

ACAAAACCACAAGTAGATAAGAACTTCGCAGATAAAGAACTTGATTATGCGAACAACAAAAAAGACAAAGGG

ACTGTCTCAGCATCTGTTGGTGATGTTAAAAAATATCATGTTGGAACAAAAATCCTTAAAGGTTCAGACTAT

AAGAAATTAATCTGGACCGATAGCATGACCAAAGGTTTGACTTTCAACAACGATATTGCTGTAACATTGGAT

GGTGCAACTCTTGATGCTACAAATTACAAACTTGTAGCAGATGACCAAGGTTTCCGCCTTGTCTTGACTGAC

AAAGGTCTTGAAGCAGTGGCAAAAGCCGCAAAAACAAAAGATGTTGAAATCAAGATCACTTACTCAGCTACT

TTGAACGGTTCTGCTGTCGTTGAAGTTCTAGAAACCAATGATGTTAAATTGGACTACGGCAACAACCCAACA

ATTGAAAATGAACCAAAAGAAGGTATTCCAGTTGATAAGAAAATCACTGTTAACAAAACATGGGCAGTAGAT

GGCAATGAAGTGAATAAAGCAGATGAAACAGTTGATGCTGTCTTCACCTTGCAAGTTAAAGATGGTGACAAA

TGGGTGAATGTTGATTCAGCTAAAGCAACAGCTGCAACTAGCTTCAAACACACTTTTGAAAACTTGGATAAT

TABLE 10-continued

Amino acid and encoding DNA sequences of gbs1477 proteins
derived from different strains of *S. agalactiae*

GCTAAAACTTACCGCGTTATCGAACGTGTTAGCGGCTACGCTCCAGAATACGTCTCATTTGTAAATGGCGTT

GTAACCATCAAGAACAACAAAGACTCAAATGAGCCAACTCCAATCAACCCATCAGAACCAAAAGTGGTGACT

TATGGACGTAAATTTGTGAAAACAAATAAAGATGGAAAAGAACGCTTGGCAGGAGCTACCTTCCTTGTTAAG

AAAGATGGCAAGTACTTGGCACGTAAATCAGGTGTTGCAACAGATGCAGAAAAAGCTGCTGTAGATTCAACT

AAATCAGCATTGGATGCTGCTGTTAAAGCTTACAATGATTTGACTAAAGAAAAACAAGAAGGTCAAGATGGT

AAATCAGCATTGGCTACCGTTAGTGAAAAACAAAAAGCTTACAATGATGCCTTTGTTAAAGCTAACTACTCA

TACGAATGGGTTGAAGATAAAAATGCTAAGAATGTTGTTAAATTGATTTCTAACGATAAAGGTCAATTTGAA

ATTACTGGCTTGACTGAAGGTCAATACTCATTGGAAGAAACACAAGCACCAACTGGTTATGCTAAATTATCA

GGTGATGTTTCGTTTAATGTTAATGCTACTTCATACAGTAAAGGTTCTGCTCAAGATATTGAGTATACCCAA

GGTTCTAAAACTAAAGATGCACAACAAGTTATCAATAAGAAGGTTACTATTCCACAAACAGGTGGTATTGGT

ACAATTTTTTTCACAATTATTGGATTAAGTATTATGCTTGGAGCGGTAGTTATCATGAAAAGACGTCAATCA

GAGGAAGTTTAA

ORF amino acid sequence (SEQ ID NO: 108):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC253
ORF DNA sequence (SEQ ID NO: 151):

ATGAAAAAAATCAACAAATGTCTTACAGTGTTCTCGACACTGCTATTGATCTTAACGTCACTATTCTCAGTT

GCACCAGCGTTTGCGGACGACGTAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATTAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACACTGGTTTTGCTTTTAACACTGCTAAGTTAAAAGGAACTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

AAAGATTTTCCTGTTTTAAACTACAAACTCGTAACAGATGACCAAGGTTTCCGTCTTGCCTTGAATGCAACA

GGTCTTGCAGCAGTAGCAGCTGCTGCAAAAGACAAAGATGTTGAAATCAAGATCACTTACTCAGCTACGGTG

AACGGCTCCACTACTGTTGAAGTTCCAGAAACCAATGATGTTAAATTGGACTATGGTAATAACCCAACGGAA

TABLE 10-continued

Amino acid and encoding DNA sequences of gbs1477 proteins derived from different strains of *S. agalactiae*

GAAAGTGAACCACAAGAAGGTACTCCAGCTAACCAAGAAATTAAAGTCATTAAAGACTGGGCAGTAGATGGT

ACAATTACTGATGTTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATACT

AAAACTTACCGCGTTGTCGAACGTGTTAGCGGCTACACTCCAGAATATGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTTGTTAAGAAA

GAAGGAAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATAGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGA

TCTGTAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTGTCATGAAAAAACGTCAATCAGAG

GAAGCTTAA

ORF amino acid sequence (SEQ ID NO: 109):

MKKINKCLTVFSTLLLILTSLFSVAPAFADDVTTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDTGFAFNTAKLKGTYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGKDFPVLNYKLVTDDQGFRLALNAT

GLAAVAAAKDKDVEIKITYSATVNGSTTVEVPETNDVKLDYGNNPTEESEPQEGTPANQEIKVIKDWAVDG

TITDVNVAVKAIFTLQEKQTDGTWVNVASHEATKPSRFEHTFTGLDNTKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYSLEETQAPAGYATLSGDVNFEVTATSYSKGATTDIAYDKGSVKKDAQQVQNKKVTIPQTGGIGT

ILFTIIGLSIMLGAVVVMKKRQSEEA

Strain IC254
ORF DNA sequence (SEQ ID NO: 152):

ATGAAAAGAATCAACAAATATTTTGCAATGTTCTCGGCATTGTTACTGACTTTAACGTCATTGCTCTCAGTT

GCACCAGCGTTTGCGGATGAAGCAACAACTAATACAGTGACTTTGCACAAGATTTTGCAAACCGAATCAAAT

CTTAACAAAAGTAACTTCCCAGGAACTACAGGTCTTAACGGAAAAGACTACAAAGGTGGAGCTATTTCTGAC

CTTGCTGGTTACTTTGGCGAGGGATCTAAAGAAATCGAAGGTGCGTTCTTTGCTTTAGCTTTGAAAGAAGAT

AAAAGTGGTAAAGTGCAATATGTTAAGGCAAAAGAAGGTAACAAATTAACACCAGCCTTAATTAATAAAGAT

GGTACTCCTGAAATAACAGTAAATATTGATGAGGCCGTGTCTGGATTGACACCAGAGGGAGATACTGGACTT

GTTTTCAACACCAAAGGATTGAAAGGCGAGTTTAAAATTGTTGAAGTTAAATCAAAATCTACTTACAACAAT

AATGGTTCCCTCCTGGCTGCTTCAAAAGCGGTTCCAGTTAACATCACTCTTCCATTGGTAAATGAAGATGGT

GTTGTTGCTGATGCCCATGTTTATCCAAAGAACACTGAAGAAAAACCAGAAATTGATAAAACTTTGCTAAA

ACAAACGATTTGACAGCATTGACAGATGTTAATAGACTTTTGACAGCTGGCGCAAATTATGGTAATTATGCA

CGTGACAAAGCAACTGCTACTGCTGAAATCGGTAAAGTTGTTCCTTATGAAGTTAAAACAAAAATTCACAAA

TABLE 10-continued

Amino acid and encoding DNA sequences of gbs1477 proteins
derived from different strains of *S. agalactiae*

GGTTCTAAATACGAAAACTTGGTTTGGACAGATATAATGTCAAATGGTTTGACAATGGGTTCAACTGTTAGC

CTTAAAGCTTCAGGAACTACAGAAACTTTTGCTAAGGATACAGACTATGAACTTAGCATTGATGCCCGTGGT

TTCACATTAAAATTCACAGCTGATGGATTGGGCAAATTGGAAAAAGCAGCTAAAACAGCTGATATTGAATTT

ACATTGACTTATAGTGCTACTGTTAATGGTCAAGCAATTATTGATAATCCAGAATCCAATGATATCAAATTG

TCGTATGGTAACAAACCAGGTAAAGACTTGACTGAACTTCCTGTTACACCTTCAAAGGGTGAAGTAACAGTT

GCTAAAACTTGGTCTGACGGAATTGCACCTGATGGTGTAAACGTTGTTTACACATTGAAAGATAAAGATAAA

ACTGTTGCTTCAGTATCATTGACAAAAACATCTAAAGGTACAATCGACCTTGGAAATGGTATCAAATTTGAA

GTATCTGGTAACTTCTCGGGTAAATTCACTGGTCTAGAAAACAAATCATACATGATCTCAGAACGTGTTTCT

GGTTACGGAAGTGCAATAAATCTAGAAAATGGTAAAGTAACCATTACCAATACCAAAGATTCTGATAACCCA

ACACCATTGAACCCAACTGAACCAAAAGTTGAAACTCATGGTAAGAAATTTGTCAAAACTAATGAACAAGGT

GACCGTTTGGCTGGTGCACAATTCGTTGTGAAAAACTCAGCAGGTAAATACCTTGCTCTTAAAGCAGATCAA

TCAGAAGGTCAAAAAACTTTAGCTGCTAAGAAAATAGCTTTAGATGAAGCTATCGCTGCTTATAACAAGTTG

TCTGCAACAGACCAAAAAGGTGAAAAAGGAATTACTGCAAAAGAACTTATCAAAACTAAACAAGCAGATTAC

GATGCAGCCTTCATTGAGGCTCGTACAGCTTATGAGTGGATAACAGATAAGGCTAGAGCCATTACCTACACT

TCAAACGATCAAGGTCAATTTGAAGTTACAGGTCTTGCAGACGGTACTTACAACCTTGAAGAAACACTTGCT

CCAGCAGGATTTGCTAAGTTGGCAGGTAATATTAAGTTTGTAGTTAATCAAGGGTCATACATAACAGGTGGT

AACATTGACTACGTTGCTAACAGCAACCAAAAGATGCGACACGTGTAGAAAATAAAAAGGTAACAATCCCA

CAAACAGGTGGTATTGGTACAATTCTTTTCACAATTATTGGTTTAAGCATTATGCTTGGAGCAGTAGTTATC

ATGAAAAGACGCCAATCAAAGGAAGCTTAA

ORF amino acid sequence (SEQ ID NO: 110):

MKRINKYFAMFSALLLTLTSLLSVAPAFADEATTNTVTLHKILQTESNLNKSNFPGTTGLNGKDYKGGAISD

LAGYFGEGSKEIEGAFFALALKEDKSGKVQYVKAKEGNKLTPALINKDGTPEITVNIDEAVSGLTPEGDTGL

VFNTKGLKGEFKIVEVKSKSTYNNNGSLLAASKAVPVNITLPLVNEDGVVADAHVYPKNTEEKPEIDKNFAK

TNDLTALTDVNRLLTAGANYGNYARDKATATAEIGKVVPYEVKTKIHKGSKYENLVWTDIMSNGLTMGSTVS

LKASGTTETFAKDTDYELSIDARGFTLKFTADGLGKLEKAAKTADIEFTLTYSATVNGQAIIDNPESNDIKL

SYGNKPGKDLTELPVTPSKGEVTVAKTWSDGIAPDGVNVVYTLKDKDKTVASVSLTKTSKGTIDLGNGIKFE

VSGNFSGKFTGLENKSYMISERVSGYGSAINLENGKVTITNTKDSDNPTPLNPTEPKVETHGKKFVKTNEQG

DRLAGAQFVVKNSAGKYLALKADQSEGQKTLAAKKIALDEAIAAYNKLSATDQKGEKGITAKELIKTKQADY

DAAFIEARTAYEWITDKARAITYTSNDQGQFEVTGLADGTYNLEETLAPAGFAKLAGNIKFVVNQGSYITGG

NIDYVANSNQKDATRVENKKVTIPQTGGIGTILFTIIGLSIMLGAVVIMKRRQSKEA

Strain IC255
ORF DNA sequence (SEQ ID NO: 153):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

TABLE 10-continued

Amino acid and encoding DNA sequences of gbs1477 proteins
derived from different strains of S. agalactiae

ATCACTCTGCCATTGGTAAACAACCAAGGTGTTGTTAAAGATGCTCACATTTATCCAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 111):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC287
ORF DNA sequence (SEQ ID NO: 154):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

TABLE 10-continued

Amino acid and encoding DNA sequences of gbs1477 proteins
derived from different strains of S. agalactiae

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 112):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

TABLE 10-continued

Amino acid and encoding DNA sequences of gbs1477 proteins
derived from different strains of *S. agalactiae*

Strain IC289
ORF DNA sequence (SEQ ID NO: 155):

ATGAAAAGAATCAACAAATATTTTGCAATGTTCTCGGCATTGTTATTAATTTTAACATCGTTGTTATCGGTA

GCTCCGGTATTTGCTGCTGAGATGGGAAATATCACTAAAACAGTAACCTTACACAAAATTGTTCAAACATCC

GATAATTTGGCTAAGCCAAATTTCCCAGGAATAAATGGATTGAATGGAACGAAGTATATGGGTCAAAAACTT

ACTGACATTTCAGGATATTTTGGGCAAGGTTCTAAAGAAATCGCCGGTGCTTTCTTTGCGGTTATGAATGAA

AGTCAGACAAAATATATCACAGAAAGTGGTACTGAAGTAGAAAGTATCGATGCAGCAGGTGTCCTTAAAGGT

TTGACAACTGAAAACGGCATTACATTTAATACTGCAAACTTAAAAGGAACATACCAAATCGTTGAGTTGCTT

GACAAATCTAATTATAAAAATGGTGACAAAGTTCTTGCTGACTCAAAAGCTGTCCCAGTGAAAATCACTCTT

CCTTTGTATAACGAAGAAGGAATTGTCGTGGACGCTGAAGTGTATCCAAAGAATACAGAAGAAGCACCACAA

ATCGACAAAAACTTTGCTAAAGCAAATAAATTGTTGAATGACAGTGATAATTCAGCTATTGCAGGTGGGGCA

GACTACGACAAATATCAGGCAGAAAAAGCAAAAGCTACTGCTGAAATCGGTCAAGAAATCCCTTACGAAGTT

AAAACAAAAATCCAAAAAGGGTCTAAATACAAAAACCTTGCTTGGGTCGATACCATGTCAAATGGTTTGACA

ATGGGTAACACTGTTAACTTAGAAGCATCGTCAGGCTCTTTTGTAGAAGGTACAGATTACAATGTTGAACGT

GATGACCGTGGTTTCACTTTGAAATTCACAGATACAGGTTTGACTAAGCTACAAAAAGAAGCGGAAACACAA

GCTGTTGAATTCACATTGACATATAGCGCAACAGTTAACGGTGCGGCTATTGATGACAAGCCAGAAAGCAAT

GATATCAAACTTCAATACGGTAACAAACCAGGTAAAAAAGTAAAAGAAATCCCAGTAACACCGTCAAATGGC

GAAATCACTGTTAGCAAAACTTGGGACAAAGGTTCAGATTTAGAGAATGCGAATGTTGTTTATACCCTTAAA

GATGGTGGAACAGCTGTTGCCTCAGTTTCATTGACAAAAACAACACCAAATGGCGAAATCAACTTAGGTAAT

GGTATTAAATTTACAGTTACTGGAGCGTTTGCTGGTAAATTCAGTGGTCTGACTGATAGTAAAACATACATG

ATCTCAGAACGTATCGCTGGTTATGGTAATACAATCACTACTGGTGCTGGTAGTGCAGCTATCACCAATACT

CCAGATTCAGACAACCCAACACCACTTAATCCAACTGAACCAAAAGTTGTGACACACGGTAAAAAATTCGTC

AAAACAAGTTCGACTGAAACAGAACGCTTGCAAGGTGCACAGTTCGTTGTTAAAGATTCAGCTGGTAAATAC

CTTGCATTGAAATCATCTGCGACAATATCAGCTCAAACAACAGCTTACACAAATGCTAAAACTGCTCTTGAC

GCTAAAATCGCAGCTTACAACAAACTTTCAGCAGACGATCAAAAAGGTACTAAAGGTGAAACAGCTAAAGCA

GAAATCAAAACTGCTCAAGACGCTTACAATGCAGCCTTCATCGTAGCTCGTACAGCTTACGAGTGGGTAACT

AATAAAGAAGATGCTAACGTTGTTAAAGTGACTTCAAACGCTGACGGTCAATTTGAAGTTAGCGGTCTTGCA

ACTGGTGATTATAAACTTGAAGAAACACAAGCTCCAGCTGGTTACGCTAAATTAGCAGGTGATGTTGATTTC

AAAGTTGGAAACAGCTCAAAAGCAGACGACTCAGGTAACATTGATTACACTGCTAGCAGCAATAAAAAAGAC

GCTCAACGCATAGAAAACAAAAAAGTGACTATTCCACAAACAGGTGGTATTGGTACAATTCTTTTCACAATT

ATTGGTTTAAGCATTATGCTTGGAGCGGTAATTATCATGAAAAGACGTCAATCAGAGGAAGCTTAA

ORF amino acid sequence (SEQ ID NO: 113):

MKRINKYFAMFSALLLILTSLLSVAPVFAAEMGNITKTVTLHKIVQTSDNLAKPNFPGINGLNGTKYMGQKL

TDISGYFGQGSKEIAGAFFAVMNESQTKYITESGTEVESIDAAGVLKGLTTENGITFNTANLKGTYQIVELL

DKSNYKNGDKVLADSKAVPVKITLPLYNEEGIVVDAEVYPKNTEEAPQIDKNFAKANKLLNDSDNSAIAGGA

DYDKYQAEKAKATAEIGQEIPYEVKTKIQKGSKYKNLAWVDTMSNGLTMGNTVNLEASSGSFVEGTDYNVER

DDRGFTLKFTDTGLTKLQKEAETQAVEFTLTYSATVNGAAIDDKPESNDIKLQYGNKPGKKVKEIPVTPSNG

EITVSKTWDKGSDLENANVVYTLKDGGTAVASVSLTKTTPNGEINLGNGIKFTVTGAFAGKFSGLTDSKTYM

ISERIAGYGNTITTGAGSAAITNTPDSDNPTPLNPTEPKVVTHGKKFVKTSSTETERLQGAQFVVKDSAGKY

TABLE 10-continued

Amino acid and encoding DNA sequences of gbs1477 proteins
derived from different strains of S. agalactiae

LALKSSATISAQTTAYTNAKTALDAKIAAYNKLSADDQKGTKGETAKAEIKTAQDAYNAAFIVARTAYEWVT

NKEDANVVKVTSNADGQFEVSGLATGDYKLEETQAPAGYAKLAGDVDFKVGNSSKADDSGNIDYTASSNKKD

AQRIENKKVTIPQTGGIGTILFTIIGLSIMLGAVIIMKRRQSEEA

Strain IC291
ORF DNA sequence (SEQ ID NO: 156):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 114):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

TABLE 10-continued

Amino acid and encoding DNA sequences of gbs1477 proteins
derived from different strains of *S. agalactiae*

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC304
ORF DNA sequence (SEQ ID NO: 157):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

TABLE 10-continued

Amino acid and encoding DNA sequences of gbs1477 proteins
derived from different strains of S. agalactiae ORF amino acid sequence (SEQ ID NO: 115):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTBTKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC305
ORF DNA sequence (SEQ ID NO: 158):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TABLE 10-continued

Amino acid and encoding DNA sequences of gbs1477 proteins derived from different strains of S. agalactiae

TCTGTAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 116):

MKKINKCLTMFSTLLLILTSLFSVAPAFADDATTDTVTLHKIVMPQAAFDNFTEGTKGKNDSDYVGKQINDL
KSYFGSTDAKEIKGAFFVFKNETGTKFITENGKEVDTLEAKDAEGGAVLSGLTKDNGFVFNTAKLKGIYQIV
ELKEKSNYDNNGSILADSKAVPVKITLPLVNNQGVVKDAHIYPKNTETKPQVDKNFADKDLDYTDNRKDKGV
VSATVGDKKEYIVGTKILKGSDYKKLVWTDSMTKGLTFNNNVKVTLDGEDFPVLNYKLVTDDQGFRLALNAT
GLAAVAAAAKDKDVEIKITYSATVNGSTTVEIPETNDVKLDYGNNPTEESEPQEGTPANQEIKVIKDWAVDG
TITDANVAVKAIFTLQEKQTDGTWVNVASHEATKPSRFEHTFTGLDNAKTYRVVERVSGYTPEYVSFKNGVV
TIKNNKNSNDPTPINPSEPKVVTYGRKFVKTNQANTERLAGATFLVKKEGKYLARKAGAATAEAKAAVKTAK
LALDEAVKAYNDLTKEKQEGQEGKTALATVDQKQKAYNDAFVKANYSYEWVADKKADNVVKLISNAGGQFEI
TGLDKGTYGLEETQAPAGYATLSGDVNFEVTATSYSKGATTDIAYDKGSVKKDAQQVQNKKVTIPQTGGIGT
ILFTIIGLSIMLGAVVIMKKRQSEEA

Strain IC306
ORF DNA sequence (SEQ ID NO: 159):

ATGAAAAAAATCAACAAATGTCTTACAATGTTCTCGACACTGCTATTGATCTTAACGTCACTATTCTCAGTT
GCACCAGCGTTTGCGGACGACGCAACAACTGATACTGTGACCTTGCACAAGATTGTCATGCCACAAGCTGCA
TTTGATAACTTTACTGAAGGTACAAAAGGTAAGAATGATAGCGATTATGTTGGTAAACAAATTAATGACCTT
AAATCTTATTTTGGCTCAACCGATGCTAAAGAAATCAAGGGTGCTTTCTTTGTTTTCAAAAATGAAACTGGT
ACAAAATTCATTACTGAAAATGGTAAGGAAGTCGATACTTTGGAAGCTAAAGATGCTGAAGGTGGTGCTGTT
CTTTCAGGGTTAACAAAAGACAATGGTTTTGTTTTTAACACTGCTAAGTTAAAAGGAATTTACCAAATCGTT
GAATTGAAAGAAAAATCAAACTACGATAACAACGGTTCTATCTTGGCTGATTCAAAAGCAGTTCCAGTTAAA
ATCACTCTGCCATTGGTAAACAACCAAGGTGTTGTTAAAGATGCTCACATTTATCCAAAGAATACTGAAACA
AAACCACAAGTAGATAAGAACTTTGCAGATAAAGATCTTGATTATACTGACAACCGAAAAGACAAAGGTGTT
GTCTCAGCGACAGTTGGTGACAAAAAAGAATACATAGTTGGAACAAAAATTCTTAAAGGCTCAGACTATAAG
AAACTGGTTTGGACTGATAGCATGACTAAAGGTTTGACGTTCAACAACAACGTTAAAGTAACATTGGATGGT
GAAGATTTTCCTGTTTTAAACTACAAACTCGTAACAGATGACCAAGGTTTCCGTCTTGCCTTGAATGCAACA
GGTCTTGCAGCAGTAGCAGCAGCTGCAAAAGACAAAGATGTTGAAATCAAGATCACTTACTCAGCTACGGTG
AACGGCTCCACTACTGTTGAAATTCCAGAAACCAATGATGTTAAATTGGACTATGGTAATAACCCAACGGAA
GAAAGTGAACCACAAGAAGGTACTCCAGCTAACCAAGAAATTAAAGTCATTAAAGACTGGGCAGTAGATGGT
ACAATTACTGATGCTAATGTTGCAGTTAAAGCTATCTTTACCTTGCAAGAAAACAAACGGATGGTACATGG
GTGAACGTTGCTTCACACGAAGCAACAAAACCATCACGCTTTGAACATACTTTCACAGGTTTGGATAATGCT
AAAACTTACCGCGTTGTCGAACGTGTTAGCGGCTACACTCCAGAATACGTATCATTTAAAAATGGTGTTGTG
ACTATCAAGAACAACAAAAACTCAAATGATCCAACTCCAATCAACCCATCAGAACCAAAAGTGGTGACTTAT
GGACGTAAATTTGTGAAAACAAATCAAGCTAACACTGAACGCTTGGCAGGAGCTACCTTCCTCGTTAAGAAA
GAAGGCAAATACTTGGCACGTAAAGCAGGTGCAGCAACTGCTGAAGCAAAGGCAGCTGTAAAAACTGCTAAA
CTAGCATTGGATGAAGCTGTTAAAGCTTATAACGACTTGACTAAAGAAAAACAAGAAGGCCAAGAAGGTAAA
ACAGCATTGGCTACTGTTGATCAAAAACAAAAAGCTTACAATGACGCTTTTGTTAAAGCTAACTACTCATAT

TABLE 10-continued

Amino acid and encoding DNA sequences of gbs1477 proteins
derived from different strains of S. agalactiae

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 117):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTBTKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC361
ORF DNA sequence (SEQ ID NO: 160):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

TABLE 10-continued

Amino acid and encoding DNA sequences of gbs1477 proteins
derived from different strains of S. agalactiae

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 118):

MKKINKCLTMFSTLLLILTSLFSVAPAFADDATTDTVTLHKIVMPQAAFDNFTEGTKGKNDSDYVGKQINDL
KSYFGSTDAKEIKGAFFVFKNETGTKFITENGKEVDTLEAKDAEGGAVLSGLTKDNGFVFNTAKLKGIYQIV
ELKEKSNYDNNGSILADSKAVPVKITLPLVNNQGVVKDAHIYPKNTETKPQVDKNFADKDLDYTDNRKDKGV
VSATVGDKKEYIVGTKILKGSDYKKLVWTDSMTKGLTFNNNVKVTLDGEDFPVLNYKLVTDDQGFRLALNAT
GLAAVAAAAKDKDVEIKITYSATVNGSTTVEIPETNDVKLDYGNNPTEESEPQEGTPANQEIKVIKDWAVDG
TITDANVAVKAIFTLQEKQTDGTWVNVASHEATKPSRFEHTFTGLDNAKTYRVVERVSGYTPEYVSFKNGVV
TIKNNKNSNDPTPINPSEPKVVTYGRKFVKTNQANTERLAGATFLVKKEGKYLARKAGAATAEAKAAVKTAK
LALDEAVKAYNDLTKEKQEGQEGKTALATVDQKQKAYNDAFVKANYSYEWVADKKADNVVKLISNAGGQFEI
TGLDKGTYGLEETQAPAGYATLSGDVNFEVTATSYSKGATTDIAYDKGSVKKDAQQVQNKKVTIPQTGGIGT
ILFTIIGLSIMLGAVVIMKKRQSEEA

Strain IC363
ORF DNA sequence (SEQ ID NO: 161):

ATGAAAAGAATCAACAAATATTTTGCAATGTTCTCGGCATTGTTACTGACTTTAACGTCATTGCTCTCAGTT

GCACCAGCGTTTGCGGATGAAGCAACAACTAATACAGTGACTTTGCACAAGATTTTGCAAACCGAATCAAAT

CTTAACAAAGTAACTTCCCAGGAACTACAGGTCTTAACGGAAAAGACTACAAAGGTGGAGCTATTTCTGAC

CTTGCTGGTTACTTTGGCGAGGGATCTAAAGAAATCGAAGGTGCGTTCTTTGCTTTAGCTTTGAAAGAAGAT

AAAAGTGGTAAAGTGCAATATGTTAAGGCAAAAGAAGGTAACAAATTAACACCAGCCTTAATTAATAAAGAT

GGTACTCCTGAAATAACAGTAAATATTGATGAGGCCGTGTCTGGATTGACACCAGAGGGAGATACTGGACTT

GTTTTCAACACCAAAGGATTGAAAGGCGAGTTTAAAATTGTTGAAGTTAAATCAAAATCTACTTACAACAAT

AATGGTTCCCTCCTGGCTGCTTCAAAAGCGGTTCCAGTTAACATCACTCTTCCATTGGTAAATGAAGATGGT

GTTGTTGCTGATGCCCATGTTTATCCAAAGAACACTGAAGAAAAACCAGAAATTGATAAAAACTTTGCTAAA

ACAAACGATTTGACAGCATTGACAGATGTTAATAGACTTTTGACAGCTGGCGCAAATTATGGTAATTATGCA

CGTGACAAAGCAACTGCTACTGCTGAAATCGGTAAAGTTGTTCCTTATGAAGTTAAAACAAAAATTCACAAA

GGTTCTAAATACGAAAACTTGGTTTGGACAGATATAATGTCAAATGGTTTGACAATGGGTTCAACTGTTAGC

CTTAAAGCTTCAGGAACTACAGAAACTTTTGCTAAGGATACAGACTATGAACTTAGCATTGATGCCCGTGGT

TTCACATTAAAATTCACAGCTGATGGATTGGGCAAATTGGAAAAAGCAGCTAAAACAGCTGATATTGAATTT

ACATTGACTTATAGTGCTACTGTTAATGGTCAAGCAATTATTGATAATCCAGAATCCAATGATATCAAATTG

TCGTATGGTAACAAACCAGGTAAAGACTTGACTGAACTTCCTGTTACACCTTCAAAGGGTGAAGTAACAGTT

GCTAAAACTTGGTCTGACGGAATTGCACCTGATGGTGTAAACGTTGTTTACACATTGAAAGATAAAGATAAA

TABLE 10-continued

Amino acid and encoding DNA sequences of gbs1477 proteins
derived from different strains of S. agalactiae

ACTGTTGCTTCAGTATCATTGACAAAAACATCTAAAGGTACAATCGACCTTGGAAATGGTATCAAATTTGAA

GTATCTGGTAACTTCTCGGGTAAATTCACTGGTCTAGAAAACAAATCATACATGATCTCAGAACGTGTTTCT

GGTTACGGAAGTGCAATAAATCTAGAAAATGGTAAAGTAACCATTACCAATACCAAAGATTCTGATAACCCA

ACACCATTGAACCCAACTGAACCAAAAGTTGAAACTCATGGTAAGAAATTTGTCAAAACTAATGAACAAGGT

GACCGTTTGGCTGGTGCACAATTCGTTGTGAAAAACTCAGCAGGTAAATACCTTGCTCTTAAAGCAGATCAA

TCAGAAGGTCAAAAAACTTTAGCTGCTAAGAAAATAGCTTTAGATGAAGCTATCGCTGCTTATAACAAGTTG

TCTGCAACAGACCAAAAGGTGAAAAAGGAATTACTGCAAAAGAACTTATCAAAACTAAACAAGCAGATTAC

GATGCAGCCTTCATTGAGGCTCGTACAGCTTATGAGTGGATAACAGATAAGGCTAGAGCCATTACCTACACT

TCAAACGATCAAGGTCAATTTGAAGTTACAGGTCTTGCAGACGGTACTTACAACCTTGAAGAAACACTTGCT

CCAGCAGGATTTGCTAAGTTGGCAGGTAATATTAAGTTTGTAGTTAATCAAGGGTCATACATAACAGGTGGT

AACATTGACTACGTTGCTAACAGCAACCAAAAGATGCGACACGTGTAGAAAATAAAAAGGTAACAATCCCA

CAAACAGGTGGTATTGGTACAATTCTTTTCACAATTATTGGTTTAAGCATTATGCTTGGAGCAGTAGTTATC

ATGAAAAGACGCCAATCAAAGGAAGCTTAA

ORF amino acid sequence (SEQ ID NO: 119):

MKRINKYFAMFSALLLTLTSLLSVAPAFADEATTNTVTLHKILQTESNLNKSNFPGTTGLNGKDYKGGAISD

LAGYFGEGSKEIEGAFFALALKEDKSGKVQYVKAKEGNKLTPALINKDGTPEITVNIDEAVSGLTPEGDTGL

VFNTKGLKGEFKIVEVKSKSTYNNNGSLLAASKAVPVNITLPLVNEDGVVADAHVYPKNTEEKPEIDKNFAK

TNDLTALTDVNRLLTAGANYGNYARDKATATAEIGKVVPYEVKTKIHKGSKYENLVWTDIMSNGLTMGSTVS

LKASGTTETFAKDTDYELSIDARGFTLKFTADGLGKLEKAAKTADIEFTLTYSATVNGQAIIDNPESNDIKL

SYGNKPGKDLTELPVTPSKGEVTVAKTWSDGIAPDGVNVVYTLKDKDKTVASVSLTKTSKGTIDLGNGIKFE

VSGNFSGKFTGLENKSYMISERVSGYGSAINLENGKVTITNTKDSDNPTPLNPTEPKVETHGKKFVKTNEQG

DRLAGAQFVVKNSAGKYLALKADQSEGQKTLAAKKIALDEAIAAYNKLSATDQKGEKGITAKELIKTKQADY

DAAFIEARTAYEWITDKARAITYTSNDQGQFEVTGLADGTYNLEETLAPAGFAKLAGNIKFVVNQGSYITGG

NIDYVANSNQKDATRVENKKVTIPQTGGIGTILFTIIGLSIMLGAVVIMKRRQSKEA

Strain IC365
ORF DNA sequence (SEQ ID NO: 162):

ATGAAAAAAATCAACAAATATTTTGCAGTCTTCTCGGCATTGCTACTGACCGTAACATCATTGTTCTCAGTT

GCACCAGTGTTTGCGGAAGAAGCAAAAACTACTGACACAGTGACCTTGCACAAGATTGTCATGCCTCGAACT

GCATTTGACGGTTTTACTGCTGGTACAAAGGGTAAGGATAATACTGACTACGTTGGTAAACAAATCGAAGAC

CTTAAAACTTACTTTGGCTCAGGCGAAGCGAAAGAAATCGCAGGTGCTTACTTTGCTTTCAAAAATGAAGCT

GGTACTAAATACATCACTGAAAATGGTGAAGAAGTTGATACTTTGGATACAACAGATGCCAAAGGTTGTGCT

GTTCTTAAAGGTTTAACAACAGACAATGGTTTCAAATTTAACACTTCTAAATTAACAGGAACTTACCAAATC

GTTGAATTGAAAGAAAATCTACATACAACAACGATGGTTCTATCTTGGCTGATTCAAAAGCAGTTCCAGTT

AAAATCACTCTTCCATTGGTAAACGACAATGGTGTTGTTAAAGACGCTCACGTTTATCCAAAGAACACTGAA

ACAAAACCACAAGTAGATAAGAACTTCGCAGATAAAGAACTTGATTATGCGAACAACAAAAAAGACAAAGGG

ACTGTCTCAGCATCTGTTGGTGATGTTAAAAAAATACCATGTTGGAACAAAAATCCTTAAAGGTTCAGACTAT

AAGAAATTAATCTGGACCGATAGCATGACCAAAGGTTTGACTTTCAACAACGATATTGCTGTAACATTGGAT

GGTGCAACTCTTGATGCTACAAATTACAAACTTGTAGCAGATGACCAAGGTTTCCGCCTTGTCTTGACTGAC

AAAGGTCTTGAAGCAGTGGCAAAAGCCGCAAAAACAAAGATGTTGAAATCAAGATCACTTACTCAGCTACT

TABLE 10-continued

Amino acid and encoding DNA sequences of gbs1477 proteins derived from different strains of *S. agalactiae*

```
TTGAACGGTTCTGCTGTCGTTGAAGTTCTAGAAACCAATGATGTTAAATTGGACTACGGCAACAACCCAACA

ATTGAAAATGAACCAAAAGAAGGTATTCCAGTTGATAAGAAAATCACTGTTAACAAAACATGGGCAGTAGAT

GGCAATGAAGTGAATAAAGCAGATGAAACAGTTGATGCTGTCTTCACCTTGCAAGTTAAAGATGGTGACAAA

TGGGTGAATGTTGATTCAGCTAAAGCAACAGCTGCAACTAGCTTCAAACACACTTTTGAAAACTTGGATAAT

GCTAAAACTTACCGCGTTATCGAACGTGTTAGCGGCTACGCTCCAGAATACGTCTCATTTGTAAATGGCGTT

GTAACCATCAAGAACAACAAAGACTCAAATGAGCCAACTCCAATCAACCCATCAGAACCAAAAGTGGTGACT

TATGGACGTAAATTTGTGAAAACAAATAAAGATGGAAAAGAACGCTTGGCAGGAGCTACCTTCCTTGTTAAG

AAAGATGGCAAGTACTTGGCACGTAAATCAGGTGTTGCAACAGATGCAGAAAAAGCTGCTGTAGATTCAACT

AAATCAGCATTGGATGCTGCTGTTAAAGCTTACAATGATTTGACTAAAGAAAAACAAGAAGGTCAAGATGGT

AAATCAGCATTGGCTACCGTTAGTGAAAAACAAAAGCTTACAATGATGCCTTTGTTAAAGCTAACTACTCA

TACGAATGGGTTGAAGATAAAAATGCTAAGAATGTTGTTAAATTGATTTCTAACGATAAAGGTCAATTTGAA

ATTACTGGCTTGACTGAAGGTCAATACTCATTGGAAGAAACACAAGCACCAACTGGTTATGCTAAATTATCA

GGTGATGTTTCGTTTAATGTTAATGCTACTTCATACAGTAAAGGTTCTGCTCAAGATATTGAGTATACCCAA

GGTTCTAAAACTAAAGATGCACAACAAGTTATCAATAAGAAGGTTACTATTCCACAAACAGGTGGTATTGGT

ACAATTTTTTTCACAATTATTGGATTAAGTATTATGCTTGGAGCGGTAGTTATCATGAAAAGACGTCAATCA

GAGGAAGTTTAA
```

ORF amino acid sequence (SEQ ID NO: 120):

```
MKKINKYFAVFSALLLTVTSLFSVAPVFAEEAKTTDTVTLHKIVMPRTAFDGFTAGTKGKDNTDYVGKQIED

LKTYFGSGEAKEIAGAYFAFKNEAGTKYITENGEEVDTLDTTDAKGCAVLKGLTTDNGFKFNTSKLTGTYQI

VELKEKSTYNNDGSILADSKAVPVKITLPLVNDNGVVKDAHVYPKNTETKPQVDKNFADKELDYANNKKDKG

TVSASVGDVKKYHVGTKILKGSDYKKLIWTDSMTKGLTFNNDIAVTLDGATLDATNYKLVADDQGFRLVLTD

KGLEAVAKAAKTKDVEIKITYSATLNGSAVVEVLETNDVKLDYGNNPTIENEPKEGIPVDKKITVNKTWAVD

GNEVNKADETVDAVFTLQVKDGDKWVNVDSAKATAATSFKHTFENLDNAKTYRVIERVSGYAPEYVSFVNGV

VTIKNNKDSNEPTPINPSEPKVVTYGRKFVKTNKDGKERLAGATFLVKKDGKYLARKSGVATDAEKAAVDST

KSALDAAVKAYNDLTKEKQEGQDGKSALATVSEKQKAYNDAFVKANYSYEWVEDKNAKNVVKLISNDKGQFE

ITGLTEGQYSLEETQAPTGYAKLSGDVSFNVNATSYSKGSAQDIEYTQGSKTKDAQQVINKKVTIPQTGGIG

TIFFTIIGLSIMLGAVVIMKRRQSEEV
```

Strain IC367
ORF DNA sequence (SEQ ID NO: 163):

```
ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG
```

TABLE 10-continued

Amino acid and encoding DNA sequences of gbs1477 proteins
derived from different strains of S. agalactiae

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 121):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC377
ORF DNA sequence (SEQ ID NO: 164):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

TABLE 10-continued

Amino acid and encoding DNA sequences of gbs1477 proteins
derived from different strains of S. agalactiae

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 122):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC379
ORF DNA sequence (SEQ ID NO: 165):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

TABLE 10-continued

Amino acid and encoding DNA sequences of gbs1477 proteins
derived from different strains of *S. agalactiae*

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 123):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

TABLE 10-continued

Amino acid and encoding DNA sequences of gbs1477 proteins
derived from different strains of *S. agalactiae*

Strain IC432
ORF DNA sequence (SEQ ID NO: 166):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAGATGCCCAACAAGTTCAAAACAAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 124):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

TABLE 10-continued

Amino acid and encoding DNA sequences of gbs1477 proteins
derived from different strains of *S. agalactiae*

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC455
ORF DNA sequence (SEQ ID NO: 167):

ATGAAAAGAATCAACAAATATTTTGCAATGTTCTCGGCATTGTTACTGACTTTAACGTCATTGCTCTCAGTT

GCACCAGCGTTTGCGGATGAAGCAACAACTAATACAGTGACTTTGCACAAGATTTTGCAAACCGAATCAAAT

CTTAACAAAAGTAACTTCCCAGGAACTACAGGTCTTAACGGAAAAGACTACAAAGGTGGAGCTATTTCTGAC

CTTGCTGGTTACTTTGGCGAGGGATCTAAAGAAATCGAAGGTGCGTTCTTTGCTTTAGCTTTGAAAGAAGAT

AAAAGTGGTAAAGTGCAATATGTTAAGGCAAAAGAAGGTAACAAATTAACACCAGCCTTAATTAATAAAGAT

GGTACTCCTGAAATAACAGTAAATATTGATGAGGCCGTGTCTGGATTGACACCAGAGGGAGATACTGGACTT

GTTTTCAACACCAAAGGATTGAAAGGCGAGTTTAAAATTGTTGAAGTTAAATCAAAATCTACTTACAACAAT

AATGGTTCCCTCCTGGCTGCTTCAAAAGCGGTTCCAGTTAACATCACTCTTCCATTGGTAAATGAAGATGGT

GTTGTTGCTGATGCCCATGTTTATCCAAAGAACACTGAAGAAAAACCAGAAATTGATAAAAACTTTGCTAAA

ACAAACGATTTGACAGCATTGACAGATGTTAATAGACTTTTGACAGCTGGCGCAAATTATGGTAATTATGCA

CGTGACAAAGCAACTGCTACTGCTGAAATCGGTAAAGTTGTTCCTTATGAAGTTAAAACAAAAATTCACAAA

GGTTCTAAATACGAAAACTTGGTTTGGACAGATATAATGTCAAATGGTTTGACAATGGGTTCAACTGTTAGC

CTTAAAGCTTCAGGAACTACAGAAACTTTTGCTAAGGATACAGACTATGAACTTAGCATTGATGCCCGTGGT

TTCACATTAAAATTCACAGCTGATGGATTGGGCAAATTGGAAAAAGCAGCTAAAACAGCTGATATTGAATTT

ACATTGACTTATAGTGCTACTGTTAATGGTCAAGCAATTATTGATAATCCAGAATCCAATGATATCAAATTG

TCGTATGGTAACAAACCAGGTAAAGACTTGACTGAACTTCCTGTTACACCTTCAAAGGGTGAAGTAACAGTT

GCTAAAACTTGGTCTGACGGAATTGCACCTGATGGTGTAAACGTTGTTTACACATTGAAAGATAAAGATAAA

ACTGTTGCTTCAGTATCATTGACAAAAACATCTAAAGGTACAATCGACCTTGGAAATGGTATCAAATTTGAA

GTATCTGGTAACTTCTCGGGTAAATTCACTGGTCTAGAAAACAAATCATACATGATCTCAGAACGTGTTTCT

GGTTACGGAAGTGCAATAAATCTAGAAAATGGTAAAGTAACCATTACCAATACCAAAGATTCTGATAACCCA

ACACCATTGAACCCAACTGAACCAAAAGTTGAAACTCATGGTAAGAAATTTGTCAAAACTAATGAACAAGGT

GACCGTTTGGCTGGTGCACAATTCGTTGTGAAAAACTCAGCAGGTAAATACCTTGCTCTTAAAGCAGATCAA

TCAGAAGGTCAAAAAACTTTAGCTGCTAAGAAAATAGCTTTAGATGAAGCTATCGCTGCTTATAACAAGTTG

TCTGCAACAGACCAAAAAGGTGAAAAAGGAATTACTGCAAAAGAACTTATCAAAACTAAACAAGCAGATTAC

GATGCAGCCTTCATTGAGGCTCGTACAGCTTATGAGTGGATAACAGATAAGGCTAGAGCCATTACCTACACT

TCAAACGATCAAGGTCAATTTGAAGTTACAGGTCTTGCAGACGGTACTTACAACCTTGAAGAAACACTTGCT

CCAGCAGGATTTGCTAAGTTGGCAGGTAATATTAAGTTTGTAGTTAATCAAGGGTCATACATAACAGGTGGT

AACATTGACTACGTTGCTAACAGCAACCAAAAAGATGCGACACGTGTAGAAAATAAAAAGGTAACAATCCCA

CAAACAGGTGGTATTGGTACAATTCTTTTCACAATTATTGGTTTAAGCATTATGCTTGGAGCAGTAGTTATC

ATGAAAAGACGCCAATCAAAGGAAGCTTAA

ORF amino acid sequence (SEQ ID NO: 125):

MKRINKYFAMFSALLLTLTSLLSVAPAFADEATTNTVTLHKILQTESNLNKSNFPGTTGLNGKDYKGGAISD

LAGYFGEGSKEIEGAFFALALKEDKSGKVQYVKAKEGNKLTPALINKDGTPEITVNIDEAVSGLTPEGDTGL

VFNTKGLKGEFKIVEVKSKSTYNNNGSLLAASKAVPVNITLPLVNEDGVVADAHVYPKNTEEKPEIDKNFAK

TABLE 10-continued

Amino acid and encoding DNA sequences of gbs1477 proteins
derived from different strains of *S. agalactiae*

TNDLTALTDVNRLLTAGANYGNYARDKATATAEIGKVVPYEVKTKIHKGSKYENLVWTDIMSNGLTMGSTVS

LKASGTTETFAKDTDYELSIDARGFTLKFTADGLGKLEKAAKTADIEFTLTYSATVNGQAIIDNPESNDIKL

SYGNKPGKDLTELPVTPSKGEVTVAKTWSDGIAPDGVNVVYTLKDKDKTVASVSLTKTSKGTIDLGNGIKFE

VSGNFSGKFTGLENKSYMISERVSGYGSAINLENGKVTITNTKDSDNPTPLNPTEPKVETHGKKFVKTNEQG

DRLAGAQFVVKNSAGKYLALKADQSEGQKTLAAKKIALDEAIAAYNKLSATDQKGEKGITAKELIKTKQADY

DAAFIEARTAYEWITDKARAITYTSNDQGQFEVTGLADGTYNLEETLAPAGFAKLAGNIKFVVNQGSYITGG

NIDYVANSNQKDATRVENKKVTIPQTGGIGTILFTIIGLSIMLGAVVIMKRRQSKEA

Strain IC457
ORF DNA sequence (SEQ ID NO: 168):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAGATGCCCAACAAGTTCAAAACAAAAAGTAACCATCCCACAAACAGGTGGTATTGGTACA

TABLE 10-continued

Amino acid and encoding DNA sequences of gbs1477 proteins
derived from different strains of *S. agalactiae*

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 126):

MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA

Strain IC458
ORF DNA sequence (SEQ ID NO: 169):

ATGAAAAAAATCAACAAATATTTTGCAGTCTTCTCGGCCTTGCTACTGACCGTAACATCATTGCTCTCAGTT

GCACCAGCGTTTGCGGACGAAGCAACAACTAATACAGTGACTTTGCACAAGATCTTGCAAACTGAATCAAAT

CTTAATAAAAGTAACTTCCCAGGAACTACAGGCCTTAACGGAGATGACTATAAAGGTGAATCTATTTCTGAC

CTTGCTAATACTTTGGATCAGGTTCTAAAGAAATTGACGGTGCTTTCTTTGCTTTGGCTTTAGAAGAGGAA

AAAGATGGTGTCGTACAATATGTTAAGGCAAAAGCAAATGACAAATTAACACCAGACTTAATTACTAAAGGT

ACACCTGCAACAACAACAAAAGTTGAAGAAGCTGTAGGTGGTTTGACAACTGGTACGGGTATTGTTTTCAAT

ACAGCTGGTTTGAAAGGTAATTTCAAAATTATTGAATTGAAAGACAAATCAACTTACAACAATAATGGTTCC

CTCTTAGCAGCTTCAAAAGCAGTTCCGGTGAAAATCACTCTTCCATTGGTAAGCAAAGATGGTGTTGTTAAA

GATGCACACGTTTATCCAAAGAACACTGAAACAAAACCAGAAGTAGACAAGAACTTCGCTAAAACAAACGAT

TTGACAGCTCTCAAAGACGCTACTCTTCTTAAGGCTGGTGCAGACTACAAAAACTATTCAGCGACTAAAGCT

ACTGTAACAGCTGAAATCGGTAAAGTTATCCCTTACGAAGTTAAAACAAAAGTTCTTAAAGGTTCTAAATAC

GAAAAACTGGTTTGGACCGATACCATGTCAAATGGTTTGACAATGGGTGATGATGTTAACCTTGCAGTTTCA

GGGACTACAACAACTTTCATTAAAGATATAGATTACACTCTTAGCATTGATGACCGTGGTTTCACATTGAAA

TTCAAAGCTACTGGATTGGACAAATTGGAAGAAGCAGCTAAAGCATCTGATGTTGAATTTACATTGACTTAT

AAAGCTACTGTTAATGGCCAAGCAATTATTGACAACCCAGAAGTCAATGACATCAAATTGGACTATGGTAAT

AAACCTGGTACAGATTTATCAGAACAACCTGTGACACCTGAAGATGGTGAAGTTAAAGTCACTAAAACATGG

GCAGCAGGTGCTAATAAAGCAGACGCTAAAGTTGTCTACACACTTAAAAATGCTACTAAACAAGTCGTAGCT

TCTGTCGCATTGACCGCAGCTGATACAAAAGGTACGATTAATCTTGGTAAAGGCATGACCTTTGAAATCACA

GGAGCTTTCTCAGGTACATTCAAAGGCCTTCAAAATAAAGCTTACACTGTTTCTGAACGTGTTGCAGGTTAT

ACTAATGCTATTAATGTTACTGGTAATGCTGTTGCTATCACCAATACACCAGACAGTGACAATCCAACGCCA

CTTAACCCAACTCAACCAAAAGTTGAAACACATGGTAAGAAATTTGTCAAAGTTGGCGATGCAGATGCCCGC

TTAGCTGGTGCACAATTCGTTGTGAAAAATTCAGCTGGTAAATTCCTTGCTCTTAAAGAAGATGCAGCTGTA

TCAGGAGCTCAAACTGAATTGGCAACTGCTAAAACAGACTTGGATAATGCCATCAAAGCTTACAACGGTTTG

ACAAAAGCGCAGCAAGAAGGTGCTGATGGTACATCAGCAAAAGAACTTATCAACACTAAACAGTCAGCTTAC

TABLE 10-continued

Amino acid and encoding DNA sequences of gbs1477 proteins
derived from different strains of *S. agalactiae*

GACGCAGCCTTCATCAAAGCACGTACAGCTTATACATGGGTAGATGAAAAAACTAAAGCTATTACCTTCACT

TCAAATAATCAAGGTCAATTTGAAGTTACTGGTCTTGAAGTAGGTTCTTACAAACTTGAAGAAACTCTTGCA

CCAGCAGGTTATGCTAAATTGTCAGGCGACATTGAGTTTACAGTTGGACACGATTCTTACACAAGTGGTGAC

ATCAAGTACAAGACAGATGATGCTAGCAACAATGCACAAAAAGTTTTCAATAAAAAAGTAACCATCCCACAA

ACAGGTGGTATTGGTACAATTCTTTTCACAATTATTGGTTTAAGCATTATGCTTGGAGCGGTAGTTATCATG

AAAAGACGTCAATCAGAGGAAGCTTAA

ORF amino acid sequence (SEQ ID NO: 127):

MKKINKYFAVFSALLLTVTSLLSVAPAFADEATTNTVTLHKILQTESNLNKSNFPGTTGLNGDDYKGESISD

LAEYFGSGSKEIDGAFFALALEEEKDGVVQYVKAKANDKLTPDLITKGTPATTTKVEEAVGGLTTGTGIVFN

TAGLKGNFKIIELKDKSTYNNNGSLLAASKAVPVKITLPLVSKDGVVKDAHVYPKNTETKPEVDKNFAKTND

LTALKDATLLKAGADYKNYSATKATVTAEIGKVIPYEVKTKVLKGSKYEKLVWTDTMSNGLTMGDDVNLAVS

GTTTTFIKDIDYTLSIDDRGFTLKFKATGLDKLEEAAKASDVEFTLTYKATVNGQAIIDNPEVNDIKLDYGN

KPGTDLSEQPVTPEDGEVKVTKTWAAGANKADAKVVYTLKNATKQVVASVALTAADTKGTINLGKGMTFEIT

GAFSGTFKGLQNKAYTVSERVAGYTNAINVTGNAVAITNTPDSDNPTPLNPTQPKVETHGKKFVKVGDADAR

LAGAQFVVKNSAGKFLALKEDAAVSGAQTELATAKTDLDNAIKAYNGLTKAQQEGADGTSAKELINTKQSAY

DAAFIKARTAYTWVDEKTKAITFTSNNQGQFEVTGLEVGSYKLEETLAPAGYAKLSGDIEFTVGHDSYTSGD

IKYKTDDASNNAQKVFNKKVTIPQTGGIGTILFTIIGLSIMLGAVVIMKRRQSEEA

Strain IC459
ORF DNA sequence (SEQ ID NO: 170):

ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAAGAATACATAGTTGGAACAAAAATTCTTAAAGGCTCAGACTATAAG

AAACTGGTTTGGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

TABLE 10-continued

Amino acid and encoding DNA sequences of gbs1477 proteins
derived from different strains of *S. agalactiae*

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA

ORF amino acid sequence (SEQ ID NO: 128):

MKKINKCLTMFSTLLLILTSLFSVAPAFADDATTDTVTLHKIVMPQAAFDNFTEGTKGKNDSDYVGKQINDL
KSYFGSTDAKEIKGAFFVFKNETGTKFITENGKEVDTLEAKDAEGGAVLSGLTKDNGFVFNTAKLKGIYQIV
ELKEKSNYDNNGSILADSKAVPVKITLPLVNNQGVVKDAHIYPKNTETKPQVDKNFADKDLDYTDNRKDKGV
VSATVGDKKEYIVGTKILKGSDYKKLVWTDSMTKGLTFNNNVKVTLDGEDFPVLNYKLVTDDQGFRLALNAT
GLAAVAAAAKDKDVEIKITYSATVNGSTTVEIPETNDVKLDYGNNPTEESEPQEGTPANQEIKVIKDWAVDG
TITDANVAVKAIFTLQEKQTDGTWVNVASHEATKPSRFEHTFTGLDNAKTYRVVERVSGYTPEYVSFKNGVV
TIKNNKNSNDPTPINPSEPKVVTYGRKFVKTNQANTERLAGATFLVKKEGKYLARKAGAATAEAKAAVKTAK
LALDEAVKAYNDLTKEKQEGQEGKTALATVDQKQKAYNDAFVKANYSYEWVADKKADNVVKLISNAGGQFEI
TGLDKGTYGLEETQAPAGYATLSGDVNFEVTATSYSKGATTDIAYDKGSVKKDAQQVQNKKVTIPQTGGIGT
ILFTIIGLSIMLGAVVIMKKRQSEEA

Strain IC460
ORF DNA sequence (SEQ ID NO: 171):

ATGAAAAGAATCAACAAATATTTTGCAATGTTCTCGGCATTGTTACTGACTTTAACGTCATTGCTCTCAGTT

GCACCAGCGTTTGCGGATGAAGCAACAACTAATACAGTGACTTTGCACAAGATTTTGCAAACCGAATCAAAT

CTTAACAAAGTAACTTCCCAGGAACTACAGGTCTTAACGGAAAAGACTACAAAGGTGGAGCTATTTCTGAC

CTTGCTGGTTACTTTGGCGAGGGATCTAAAGAAATCGAAGGTGCGTTCTTTGCTTTAGCTTTGAAAGAAGAT

AAAAGTGGTAAAGTGCAATATGTTAAGGCAAAAGAAGGTAACAAATTAACACCAGCCTTAATTAATAAAGAT

GGTACTCCTGAAATAACAGTAAATATTGATGAGGCCGTGTCTGGATTGACACCAGAGGGAGATACTGGACTT

GTTTTCAACACCAAAGGATTGAAAGGCGAGTTTAAAATTGTTGAAGTTAAATCAAAATCTACTTACAACAAT

AATGGTTCCCTCCTGGCTGCTTCAAAAGCGGTTCCAGTTAACATCACTCTTCCATTGGTAAATGAAGATGGT

GTTGTTGCTGATGCCCATGTTTATCCAAAGAACACTGAAGAAAAACCAGAAATTGATAAAAACTTTGCTAAA

ACAAACGATTTGACAGCATTGACAGATGTTAATAGACTTTTGACAGCTGGCGCAAATTATGGTAATTATGCA

CGTGACAAAGCAACTGCTACTGCTGAAATCGGTAAAGTTGTTCCTTATGAAGTTAAAACAAAAATTCACAAA

GGTTCTAAATACGAAAACTTGGTTTGGACAGATATAATGTCAAATGGTTTGACAATGGGTTCAACTGTTAGC

CTTAAAGCTTCAGGAACTACAGAAACTTTTGCTAAGGATACAGACTATGAACTTAGCATTGATGCCCGTGGT

TTCACATTAAAATTCACAGCTGATGGATTGGGCAAATTGGAAAAAGCAGCTAAAACAGCTGATATTGAATTT

ACATTGACTTATAGTGCTACTGTTAATGGTCAAGCAATTATTGATAATCCAGAATCCAATGATATCAAATTG

TCGTATGGTAACAAACCAGGTAAAGACTTGACTGAACTTCCTGTTACACCTTCAAAGGGTGAAGTAACAGTT

GCTAAAACTTGGTCTGACGGAATTGCACCTGATGGTGTAAACGTTGTTTACACATTGAAAGATAAAGATAAA

TABLE 10-continued

Amino acid and encoding DNA sequences of gbs1477 proteins
derived from different strains of S. agalactiae

ACTGTTGCTTCAGTATCATTGACAAAAACATCTAAAGGTACAATCGACCTTGGAAATGGTATCAAATTTGAA

GTATCTGGTAACTTCTCGGGTAAATTCACTGGTCTAGAAAACAAATCATACATGATCTCAGAACGTGTTTCT

GGTTACGGAAGTGCAATAAATCTAGAAAATGGTAAAGTAACCATTACCAATACCAAAGATTCTGATAACCCA

ACACCATTGAACCCAACTGAACCAAAAGTTGAAACTCATGGTAAGAAATTTGTCAAAACTAATGAACAAGGT

GACCGTTTGGCTGGTGCACAATTCGTTGTGAAAAACTCAGCAGGTAAATACCTTGCTCTTAAAGCAGATCAA

TCAGAAGGTCAAAAAACTTTAGCTGCTAAGAAAATAGCTTTAGATGAAGCTATCGCTGCTTATAACAAGTTG

TCTGCAACAGACCAAAAGGTGAAAAAGGAATTACTGCAAAAGAACTTATCAAAACTAAACAAGCAGATTAC

GATGCAGCCTTCATTGAGGCTCGTACAGCTTATGAGTGGATAACAGATAAGGCTAGAGCCATTACCTACACT

TCAAACGATCAAGGTCAATTTGAAGTTACAGGTCTTGCAGACGGTACTTACAACCTTGAAGAAACACTTGCT

CCAGCAGGATTTGCTAAGTTGGCAGGTAATATTAAGTTTGTAGTTAATCAAGGGTCATACATAACAGGTGGT

AACATTGACTACGTTGCTAACAGCAACCAAAAGATGCGACACGTGTAGAAAATAAAAAGGTAACAATCCCA

CAAACAGGTGGTATTGGTACAATTCTTTTCACAATTATTGGTTTAAGCATTATGCTTGGAGCAGTAGTTATC

ATGAAAAGACGCCAATCAAAGGAAGCTTAA

ORF amino acid sequence (SEQ ID NO: 129):

MKRINKYFAMFSALLLTLTSLLSVAPAFADEATTNTVTLHKILQTESNLNKSNFPGTTGLNGKDYKGGAISD

LAGYFGEGSKEIEGAFFALALKEDKSGKVQYVKAKEGNKLTPALINKDGTPEITVNIDEAVSGLTPEGDTGL

VFNTKGLKGEFKIVEVKSKSTYNNNGSLLAASKAVPVNITLPLVNEDGVVADAHVYPKNTEEKPEIDKNFAK

TNDLTALTDVNRLLTAGANYGNYARDKATATAEIGKVVPYEVKTKIHKGSKYENLVWTDIMSNGLTMGSTVS

LKASGTTETFAKDTDYELSIDARGFTLKFTADGLGKLEKAAKTADIEFTLTYSATVNGQAIIDNPESNDIKL

SYGNKPGKDLTELPVTPSKGEVTVAKTWSDGIAPDGVNVVYTLKDKDKTVASVSLTKTSKGTIDLGNGIKFE

VSGNFSGKFTGLENKSYMISERVSGYGSAINLENGKVTITNTKDSDNPTPLNPTEPKVETHGKKFVKTNEQG

DRLAGAQFVVKNSAGKYLALKADQSEGQKTLAAKKIALDEAIAAYNKLSATDQKGEKGITAKELIKTKQADY

DAAFIEARTAYEWITDKARAITYTSNDQGQFEVTGLADGTYNLEETLAPAGFAKLAGNIKFVVNQGSYITGG

NIDYVANSNQKDATRVENKKVTIPQTGGIGTILFTIIGLSIMLGAVVIMKRRQSKEA

Strain IC461
ORF DNA sequence (SEQ ID NO: 172):

ATGAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAAATGGTAAGGAAGTCGATACTTTGGAAGCTAAAGATGCTGAAGGTGGTGCTGTT

CTTTCAGGGTTAACAAAAGACAATGGTTTTGTTTTTAACACTGCTAAGTTAAAAGGAATTTACCAAATCGTT

GAATTGAAAGAAAATCAAACTACGATAACAACGGTTCTATCTTGGCTGATTCAAAAGCAGTTCCAGTTAAA

ATCACTCTGCCATTGGTAAACAACCAAGGTGTTGTTAAAGATGCTCACATTTATCCAAAGAATACTGAAACA

AAACCACAAGTAGATAAGAACTTTGCAGATAAAGATCTTGATTATACTGACAACCGAAAAGACAAAGGTGTT

GTCTCAGCGACAGTTGGTGACAAAAAGAATACATAGTTGGAACAAAAATTCTTAAAGGCTCAGACTATAAG

AAACTGGTTTGACTGATAGCATGACTAAAGGTTTGACGTTCAACAACAACGTTAAAGTAACATTGGATGGT

GAAGATTTTCCTGTTTTAAACTACAAACTCGTAACAGATGACCAAGGTTTCCGTCTTGCCTTGAATGCAACA

GGTCTTGCAGCAGTAGCAGCAGCTGCAAAAGACAAAGATGTTGAAATCAAGATCACTTACTCAGCTACGGTG

TABLE 10-continued

Amino acid and encoding DNA sequences of gbs1477 proteins
derived from different strains of S. agalactiae

```
AACGGCTCCACTACTGTTGAAATTCCAGAAACCAATGATGTTAAATTGGACTATGGTAATAACCCAACGGAA

GAAAGTGAACCACAAGAAGGTACTCCAGCTAACCAAGAAATTAAAGTCATTAAAGACTGGGCAGTAGATGGT

ACAATTACTGATGCTAATGTTGCAGTTAAAGCTATCTTTACCTTGCAAGAAAAACAAACGGATGGTACATGG

GTGAACGTTGCTTCACACGAAGCAACAAAACCATCACGCTTTGAACATACTTTCACAGGTTTGGATAATGCT

AAAACTTACCGCGTTGTCGAACGTGTTAGCGGCTACACTCCAGAATACGTATCATTTAAAAATGGTGTTGTG

ACTATCAAGAACAACAAAAACTCAAATGATCCAACTCCAATCAACCCATCAGAACCAAAAGTGGTGACTTAT

GGACGTAAATTTGTGAAAACAAATCAAGCTAACACTGAACGCTTGGCAGGAGCTACCTTCCTCGTTAAGAAA

GAAGGCAAATACTTGGCACGTAAAGCAGGTGCAGCAACTGCTGAAGCAAAGGCAGCTGTAAAAACTGCTAAA

CTAGCATTGGATGAAGCTGTTAAAGCTTATAACGACTTGACTAAAGAAAAACAAGAAGGCCAAGAAGGTAAA

ACAGCATTGGCTACTGTTGATCAAAAACAAAAAGCTTACAATGACGCTTTTGTTAAAGCTAACTACTCATAT

GAATGGGTTGCAGATAAAAAGGCTGATAATGTTGTTAAATTGATCTCTAACGCCGGTGGTCAATTTGAAATT

ACTGGTTTGGATAAAGGCACTTATGGCTTGGAAGAAACTCAAGCACCAGCAGGTTATGCGACATTGTCAGGT

GATGTAAACTTTGAAGTAACTGCCACATCATATAGCAAAGGGGCTACAACTGACATCGCATATGATAAAGGC

TCTGTAAAAAAAGATGCCCAACAAGTTCAAAACAAAAAGTAACCATCCCACAAACAGGTGGTATTGGTACA

ATTCTTTTCACAATTATTGGTTTAAGCATTATGCTTGGAGCAGTAGTTATCATGAAAAAACGTCAATCAGAG

GAAGCTTAA
```

ORF amino acid sequence (SEQ ID NO: 130):

```
MKKINKCLTMFSTLLLILTSLFSVAPAFADDATTDTVTLHKIVMPQAAFDNFTEGTKGKNDSDYVGKQINDL

KSYFGSTDAKEIKGAFFVFKNETGTKFITENGKEVDTLEAKDAEGGAVLSGLTKDNGFVFNTAKLKGIYQIV

ELKEKSNYDNNGSILADSKAVPVKITLPLVNNQGVVKDAHIYPKNTETKPQVDKNFADKDLDYTDNRKDKGV

VSATVGDKKEYIVGTKILKGSDYKKLVWTDSMTKGLTFNNNVKVTLDGEDFPVLNYKLVTDDQGFRLALNAT

GLAAVAAAKDKDVEIKITYSATVNGSTTVEIPETNDVKLDYGNNPTEESEPQEGTPANQEIKVIKDWAVDG

TITDANVAVKAIFTLQEKQTDGTWVNVASHEATKPSRFEHTFTGLDNAKTYRVVERVSGYTPEYVSFKNGVV

TIKNNKNSNDPTPINPSEPKVVTYGRKFVKTNQANTERLAGATFLVKKEGKYLARKAGAATAEAKAAVKTAK

LALDEAVKAYNDLTKEKQEGQEGKTALATVDQKQKAYNDAFVKANYSYEWVADKKADNVVKLISNAGGQFEI

TGLDKGTYGLEETQAPAGYATLSGDVNFEVTATSYSKGATTDIAYDKGSVKKDAQQVQNKKVTIPQTGGIGT

ILFTIIGLSIMLGAVVIMKKRQSEEA
```

Strain IC462
ORF DNA sequence (SEQ ID NO: 173):

```
ATGAAAAGAATCAACAAATATTTTGCAATGTTCTCGGCATTGTTACTGACTTTAACGTCATTGCTCTCAGTT

GCACCAGCGTTTGCGGATGAAGCAACAACTAATACAGTGACTTTGCACAAGATTTTGCAAACCGAATCAAAT

CTTAACAAAAGTAACTTCCCAGGAACTACAGGTCTTAACGGAAAAGACTACAAAGGTGGAGCTATTTCTGAC

CTTGCTGGTTACTTTGGCGAGGGATCTAAAGAAATCGAAGGTGCGTTCTTTGCTTTAGCTTTGAAAGAAGAT

AAAAGTGGTAAAGTGCAATATGTTAAGGCAAAAGAAGGTAACAAATTAACACCAGCCTTAATTAATAAAGAT

GGTACTCCTGAAATAACAGTAAATATTGATGAGGCCGTGTCTGGATTGACACCAGAGGGAGATACTGGACTT

GTTTTCAACACCAAAGGATTGAAAGGCGAGTTTAAAATTGTTGAAGTTAAATCAAAATCTACTTACAACAAT

AATGGTTCCCTCCTGGCTGCTTCAAAAGCGGTTCCAGTTAACATCACTCTTCCATTGGTAAATGAAGATGGT

GTTGTTGCTGATGCCCATGTTTATCCAAAGAACACTGAAGAAAAACCAGAAATTGATAAAAACTTTGCTAAA

ACAAACGATTTGACAGCATTGACAGATGTTAATAGACTTTTGACAGCTGGCGCAAATTATGGTAATTATGCA
```

TABLE 10-continued

Amino acid and encoding DNA sequences of gbs1477 proteins
derived from different strains of S. agalactiae

```
CGTGACAAAGCAACTGCTACTGCTGAAATCGGTAAAGTTGTTCCTTATGAAGTTAAAACAAAAATTCACAAA

GGTTCTAAATACGAAAACTTGGTTTGGACAGATATAATGTCAAATGGTTTGACAATGGGTTCAACTGTTAGC

CTTAAAGCTTCAGGAACTACAGAAACTTTTGCTAAGGATACAGACTATGAACTTAGCATTGATGCCCGTGGT

TTCACATTAAAATTCACAGCTGATGGATTGGGCAAATTGGAAAAAGCAGCTAAAACAGCTGATATTGAATTT

ACATTGACTTATAGTGCTACTGTTAATGGTCAAGCAATTATTGATAATCCAGAATCCAATGATATCAAATTG

TCGTATGGTAACAAACCAGGTAAAGACTTGACTGAACTTCCTGTTACACCTTCAAAGGGTGAAGTAACAGTT

GCTAAAACTTGGTCTGACGGAATTGCACCTGATGGTGTAAACGTTGTTTACACATTGAAAGATAAAGATAAA

ACTGTTGCTTCAGTATCATTGACAAAAACATCTAAAGGTACAATCGACCTTGGAAATGGTATCAAATTTGAA

GTATCTGGTAACTTCTCGGGTAAATTCACTGGTCTAGAAAACAAATCATACATGATCTCAGAACGTGTTTCT

GGTTACGGAAGTGCAATAAATCTAGAAAATGGTAAAGTAACCATTACCAATACCAAAGATTCTGATAACCCA

ACACCATTGAACCCAACTGAACCAAAAGTTGAAACTCATGGTAAGAAATTTGTCAAAACTAATGAACAAGGT

GACCGTTTGGCTGGTGCACAATTCGTTGTGAAAAACTCAGCAGGTAAATACCTTGCTCTTAAAGCAGATCAA

TCAGAAGGTCAAAAAACTTTAGCTGCTAAGAAAATAGCTTTAGATGAAGCTATCGCTGCTTATAACAAGTTG

TCTGCAACAGACCAAAAAGGTGAAAAAGGAATTACTGCAAAAGAACTTATCAAAACTAAACAAGCAGATTAC

GATGCAGCCTTCATTGAGGCTCGTACAGCTTATGAGTGGATAACAGATAAGGCTAGAGCCATTACCTACACT

TCAAACGATCAAGGTCAATTTGAAGTTACAGGTCTTGCAGACGGTACTTACAACCTTGAAGAAACACTTGCT

CCAGCAGGATTTGCTAAGTTGGCAGGTAATATTAAGTTTGTAGTTAATCAAGGGTCATACATAACAGGTGGT

AACATTGACTACGTTGCTAACAGCAACCAAAAGATGCGACACGTGTAGAAAATAAAAAGGTAACAATCCCA

CAAACAGGTGGTATTGGTACAATTCTTTTCACAATTATTGGTTTAAGCATTATGCTTGGAGCAGTAGTTATC

ATGAAAAGACGCCAATCAAAGGAAGCTTAA
```

ORF amino acid sequence (SEQ ID NO: 131):

```
MKRINKYFAMFSALLLTLTSLLSVAPAFADEATTNTVTLHKILQTESNLNKSNFPGTTGLNGKDYKGGAISD

LAGYFGEGSKEIEGAFFALALKEDKSGKVQYVKAKEGNKLTPALINKDGTPEITVNIDEAVSGLTPEGDTGL

VFNTKGLKGEFKIVEVKSKSTYNNNGSLLAASKAVPVNITLPLVNEDGVVADAHVYPKNTEEKPEIDKNFAK

TNDLTALTDVNRLLTAGANYGNYARDKATATAEIGKVVPYEVKTKIHKGSKYENLVWTDIMSNGLTMGSTVS

LKASGTTETFAKDTDYELSIDARGFTLKFTADGLGKLEKAAKTADIEFTLTYSATVNGQAIIDNPESNDIKL

SYGNKPGKDLTELPVTPSKGEVTVAXTWSDGIAPDGVNVVYTLKDKDKTVASVSLTKTSKGTIDLGNGIKFE

VSGNFSGKFTGLENKSYMISERVSGYGSAINLENGKVTITNTKDSDNPTPLNPTEPKVETHGKKFVKTNEQG

DRLAGAQFVVKNSAGKYLALKADQSEGQKTLAAKKIALDEAIAAYNKLSATDQKGEKGITAKELIKTKQADY

DAAFIEARTAYEWITDKARAITYTSNDQGQFEVTGLADGTYNLEETLAPAGFAKLAGNIKFVVNQGSYITGG

NIDYVANSNQKDATRVENKKVTIPQTGGIGTILFTIIGLSIMLGAVVIMKRRQSKEA
```

Strain IC470
ORF DNA sequence (SEQ ID NO: 174):

```
ATGAAAAAAATCAACAAATGTCTTACAATGTTCTCGACACTGCTATTGATCTTAACGTCACTATTCTCAGTT

GCACCAGCGTTTGCGGACGACGCAACAACTGATACTGTGACCTTGCACAAGATTGTCATGCCACAAGCTGCA

TTTGATAACTTTACTGAAGGTACAAAAGGTAAGAATGATAGCGATTATGTTGGTAAACAAATTAATGACCTT

AAATCTTATTTTGGCTCAACCGATGCTAAAGAAATCAAGGGTGCTTTCTTTGTTTTCAAAAATGAAACTGGT

ACAAAATTCATTACTGAAATGGTAAGGAAGTCGATACTTTGGAAGCTAAGATGCTGAAGGTGGTGCTGTT

CTTTCAGGGTTAACAAAAGACAATGGTTTTGTTTTTAACACTGCTAAGTTAAAAGGAATTTACCAAATCGTT
```

TABLE 10-continued

Amino acid and encoding DNA sequences of gbs1477 proteins derived from different strains of *S. agalactiae*

GAATTGAAAGAAAAATCAAACTACGATAACAACGGTTCTATCTTGGCTGATTCAAAAGCAGTTCCAGTTAAA
ATCACTCTGCCATTGGTAAACAACCAAGGTGTTGTTAAAGATGCTCACATTTATCCAAAGAATACTGAAACA
AAACCACAAGTAGATAAGAACTTTGCAGATAAAGATCTTGATTATACTGACAACCGAAAAGACAAAGGTGTT
GTCTCAGCGACAGTTGGTGACAAAAAGAATACATAGTTGGAACAAAAATTCTTAAAGGCTCAGACTATAAG
AAACTGGTTTGGACTGATAGCATGACTAAAGGTTTGACGTTCAACAACAACGTTAAAGTAACATTGGATGGT
GAAGATTTTCCTGTTTTAAACTACAAACTCGTAACAGATGACCAAGGTTTCCGTCTTGCCTTGAATGCAACA
GGTCTTGCAGCAGTAGCAGCAGCTGCAAAAGACAAAGATGTTGAAATCAAGATCACTTACTCAGCTACGGTG
AACGGCTCCACTACTGTTGAAATTCCAGAAACCAATGATGTTAAATTGGACTATGGTAATAACCCAACGGAA
GAAAGTGAACCACAAGAAGGTACTCCAGCTAACCAAGAAATTAAAGTCATTAAAGACTGGGCAGTAGATGGT
ACAATTACTGATGCTAATGTTGCAGTTAAAGCTATCTTTACCTTGCAAGAAAAACAAACGGATGGTACATGG
GTGAACGTTGCTTCACACGAAGCAACAAAACCATCACGCTTTGAACATACTTTCACAGGTTTGGATAATGCT
AAAACTTACCGCGTTGTCGAACGTGTTAGCGGCTACACTCCAGAATACGTATCATTTAAAAATGGTGTTGTG
ACTATCAAGAACAACAAAAACTCAAATGATCCAACTCCAATCAACCCATCAGAACCAAAAGTGGTGACTTAT
GGACGTAAATTTGTGAAAACAAATCAAGCTAACACTGAACGCTTGGCAGGAGCTACCTTCCTCGTTAAGAAA
GAAGGCAAATACTTGGCACGTAAAGCAGGTGCAGCAACTGCTGAAGCAAAGGCAGCTGTAAAAACTGCTAAA
CTAGCATTGGATGAAGCTGTTAAAGCTTATAACGACTTGACTAAAGAAAAACAAGAAGGCCAAGAAGGTAAA
ACAGCATTGGCTACTGTTGATCAAAAACAAAAAGCTTACAATGACGCTTTTGTTAAAGCTAACTACTCATAT
GAATGGGTTGCAGATAAAAAGGCTGATAATGTTGTTAAATTGATCTCTAACGCCGGTGGTCAATTTGAAATT
ACTGGTTTGGATAAAGGCACTTATGGCTTGGAAGAAACTCAAGCACCAGCAGGTTATGCGACATTGTCAGGT
GATGTAAACTTTGAAGTAACTGCCACATCATATAGCAAAGGGGCTACAACTGACATCGCATATGATAAAGGC
TCTGTAAAAAAAGATGCCCAACAAGTTCAAAACAAAAAAGTAACCATCCCACAAACAGGTGGTATTGGTACA
ATTCTTTTCACAATTATTGGTTTAAGCATTATGCTTGGAGCAGTAGTTATCATGAAAAAACGTCAATCAGAG
GAAGCTTAA

ORF amino acid sequence (SEQ ID NO: 132):

MKKINKCLTMFSTLLLILTSLFSVAPAFADDATTDTVTLHKIVMPQAAFDNFTEGTKGKNDSDYVGKQINDL
KSYFGSTDAKEIKGAFFVFKNETGTKFITENGKEVDTLEAKDAEGGAVLSGLTKDNGFVFNTAKLKGIYQIV
ELKEKSNYDNNGSILADSKAVPVKITLPLVNNQGVVKDAHIYPKNTETKPQVDKNFADKDLDYTDNRKDKGV
VSATVGDKKEYIVGTKILKGSDYKKLVWTDSMTKGLTFNNNVKVTLDGEDFPVLNYKLVTDDQGFRLALNAT
GLAAVAAAKDKDVEIKITYSATVNGSTTVEIPETNDVKLDYGNNPTEESEPQEGTPANQEIKVIKDWAVDG
TITDANVAVKAIFTLQEKQTDGTWVNVASHEATKPSRFEHTFTGLDNAKTYRVVERVSGYTPEYVSFKNGVV
TIKNNKNSNDPTPINPSEPKVVTYGRKFVKTNQANTERLAGATFLVKKEGKYLARKAGAATAEAKAAVKTAK
LALDEAVKAYNDLTKEKQEGQEGKTALATVDQKQKAYNDAFVKANYSYEWVADKKADNVVKLISNAGGQFEI
TGLDKGTYGLEETQAPAGYATLSGDVNFEVTATSYSKGATTDIAYDKGSVKKDAQQVQNKKVTIPQTGGIGT
ILFTIIGLSIMLGAVVIMKKRQSEEA

TABLE 11

Amino acid and encoding DNA sequences of gbs1478 proteins derived from different strains of S. agalactiae Strain 12401
ORF DNA sequence (SEQ ID NO: 204):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAACCTACTTCACACTCAGAAAGCAAAGTAGAA

AAAGTAACTACTGAGGTAACAGGTGAAGCTACTTTTGATAATCTCACACCTGGAGATTACACTTTATCAGAA

GAAACGGCACCCGAAGGATACAAAAAGACTACCCAGACTTGGCAAGTTAAGGTTGAGAGTAATGGAAAAACT

ACGATACAAAATAGTGATGATAAAAAATCTATAATTGAACAAAGGCAAGAGGAACTAGATAAGCAGTATCCC

CTTACAGGAGCTTATGAAGATACAAAAGAATCTTATAATCTTGAGCATGTTAAAAATTCAATTCCAAATGGG

AAATTAGAGGCAAAAGCAGTTAATCCATATTCAAGTGAAGGTGAGCACATAAGAGAAATTCAAGAGGGAACA

TTATCTAAACGTATTTCAGAAGTAAATGATTTGGATCATAATAAATATAAAATTGAGTTAACTGTTAGCGGT

AAATCCATAATAAAAACTATAAATAAAGATGAACCTCTGGATGTTGTTTTTGTTCTTGATAATTCAAATTCT

ATGAAGAATAATGGAAAAAATAACAAGGCAAAAAAGGCAGGTGAAGCAGTAGAAACAATTATAAAAGATGTT

TTAGGAGCAAATGTTGAAAACCGAGCAGCTTTAGTTACTTATGGTTCAGATATTTTTGATGGAAGGACAGTT

AAAGTTATAAAAGGTTTTAAAGAGGATCCTTATTATGGACTTGAAACTAGTTTCACAGTTCAGACAAATGAT

TATAGCTATAAAAGTTCACTAATATTGCTGCTGATATTATAAAAAGATCCCTAAAGAAGCTCCAGAAGCT

AAGTGGGGGGGACAAGTCTAGGATTAACTCCAGAAAAAAGAGGGAATATGATTTAAGTAAAGTAGGTGAG

ACCTTTACAATGAAAGCTTTTATGGAGGCAGATACCTTGTTAAGTAGTATACAGCGTAAGAGTAGAAAGATT

ATTGTTCATCTAACTGACGGTGTTCCAACAAGATCATATGCCATTAATAGTTTTGTAAAAGGTTCAACATAC

GCAAATCAATTTGAGAGAATAAAAGAAAAAGGTTATTTAGACAAAAATAATTATTTTATAACTGATGATCCA

GAAAAGATCAAAGGCAATGGGAGAGTTACTTTTTGTTTCCCTTAGATAGTTATCAAACACAGATAATTTCT

GGAAACTTACAAAAACTTCATTATTTAGATTTAAATCTTAATTACCCTAAAGGTACAATTTATAGAAATGGA

CCAGTAAGAGAACATGGAACACCAACCAAACTTTATATAAATAGTTTAAAACAGAAAAATTATGACATCTTT

AATTTTGGTATAGATATATCTGGTTTTAGACAAGTTTATAATGAGGATTATAAGAAAAATCAAGATGGTACT

TTTCAAAAATTGAAGGAGGAAGCTTTTGAACTTTCAGATGGGGAAATAACAGAACTAATGAATTCATTCTCT

TCTAAACCTGAGTATTATACCCCGATAGTAACTTCAGCTGATGTATCTAATAATGAAATTTTATCTAAAATT

CAGCAACAATTTGAAAAGATTTTAACAAAGGAAAACTCAATTGTTAATGGAACTATAGAAGATCCTATGGGT

GATAAAATCAATTTACATCTTGGCAACGGACAAACATTGCAACCAAGTGATTATACTTTACAGGGAAATGAT

GGAAGTATAATGAAAGATAGCATTGCAACTGGAGGGCCTAATAATGATGGTGGGATACTTAAAGGGGTTAAA

TTAGAATACATCAAAAATAAACTCTACGTTAGAGGTTTGAACTTAGGGGAGGGGCAAAAAGTAACACTCACA

TATGATGTGAAACTAGATGACAGTTTTATTAGTAACAAATTCTATGACACTAATGGTAGAACAACATTGAAT

CCTAAATCAGAGGAACCCGATACACTTAGAGATTTTCCAATCCCTAAAATTCGTGATGTGAGAGAATATCCT

ACAATAACGATTAAAAACGAGAAGAAGTTAGGTGAAATTGAATTTACAAAAGTTGATAAAGATAATAATAAG

TTGCTTCTCAAAGGAGCTACATTTGAACTTCAAGAATTTAATGAAGATTATAAACTTTATTTACCAATAAAA

AATAATAATTCAAAAGTAGTGACGGGAGAAAACGGCAAAATTTCTTACAAAGATTTGAAAGATGGCAAATAT

CAGTTAATAGAAGCAGTTTCGCCGAAGGATTATCAAAAAATTACTAATAAACCAATTTTAACTTTTGAAGTT

GTTAAAGGATCGATACAAAATATAATAGCTGTTAATAAACAGATTTCTGAATATCATGAGGAAGGTGACAAG

CATTTAATTACCAACACGCATATTCCACCAAAAGGAATTATTCCGATGACAGGTGGGAAAGGAATTCTATCT

TABLE 11-continued

Amino acid and encoding DNA sequences of gbs1478 proteins derived from different strains of *S. agalactiae*

TTCATTTTAATAGGTGGAGCTATGATGTCTATTGCAGGTGGAATTTATATTTGGAAAAGACATAAGAAATCT

AGTGATGCATCAATCGAGAAAGATTAA

ORF amino acid sequence (SEQ ID NO: 185):

MRKYQKFSKILTLSLFCLSQIPLNTNVLGESTVPENGAKGKLVVKKTDDQNKPLSKATFVLKPTSHSESKVE

KVTTEVTGEATFDNLTPGDYTLSEETAPEGYKKTTQTWQVKVESNGKTTIQNSDDKKSIIEQRQEELDKQYP

LTGAYEDTKESYNLEHVKNSIPNGKLEAKAVNPYSSEGEHIREIQEGTLSKRISEVNDLDHNKYKIELTVSG

KSIIKTINKDEPLDVVFVLDNSNSMKNNGKNNKAKKAGEAVETIIKDVLGANVENRAALVTYGSDIFDGRTV

KVIKGFKEDPYYGLETSFTVQTNDYSYKKFTNIAADIIKKIPKEAPEAKWGGTSLGLTPEKKREYDLSKVGE

TFTMKAFMEADTLLSSIQRKSRKIIVHLTDGVPTRSYAINSFVKGSTYANQFERIKEKGYLDKNNYFITDDP

EKIKGNGESYFLFPLDSYQTQIISGNLQKLHYLDLNLNYPKGTIYRNGPVREHGTPTKLYINSLKQKNYDIF

NFGIDISGFRQVYNEDYKKNQDGTFQKLKEEAFELSDGEITELMNSFSSKPEYYTPIVTSADVSNNEILSKI

QQQFEKILTKENSIVNGTIEDPMGDKINLHLGNGQTLQPSDYTLQGNDGSIMKDSIATGGPNNDGGILKGVK

LEYIKNKLYVRGLNLGEGQKVTLTYDVKLDDSFISNKFYDTNGRTTLNPKSEEPDTLRDFPIPKIRDVREYP

TITIKNEKKLGEIEFTKVDKDNNKLLLKGATFELQEFNEDYKLYLPIKNNNSKVVTGENGKISYKDLKDGKY

QLIEAVSPKDYQKITNKPILTFEVVKGSIQNIIAVNKQISEYHEEGDKHLITNTHIPPKGIIPMTGGKGILS

FILIGGAMMSIAGGIYIWKRHKKSSDASIEKD

Strain BAA23
ORF DNA sequence (SEQ ID NO: 205):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAAACTACTGCTCATCCAGAAAGTAAAATAGAA

AAAGTAACTGCTGAGCTAACAGGTGAAGCTACTTTTGATAATCTCATACCTGGAGATTATACTTTATCAGAA

GAAACAGCGCCCGAAGGTTATAAAAAGACTAACCAGACTTGGCAAGTTAAGGTTGAGAGTAATGGAAAAACT

ACGATACAAAATAGTGGTGATAAAAATTCCACAATTGGACAAAATCAGGAAGAACTAGATAAGCAGTATCCC

CCCACAGGAATTTATGAAGATACAAAGGAATCTTATAAACTTGAGCATGTTAAAGGTTCAGTTCCAAATGGA

AAGTCAGAGGCAAAAGCAGTTAACCCATATTCAAGTGAAGGTGAGCATATAAGAGAAATTCCAGAGGGAACA

TTATCTAAACGTATTTCAGAAGTAGGTGATTTAGCTCATAATAAATATAAAATTGAGTTAACTGTCAGTGGA

AAAACCATAGTAAAACCAGTGGACAAACAAAAGCCGTTAGATGTTGTCTTCGTACTCGATAATTCTAACTCA

ATGAATAACGATGGCCCAAATTTTCAAAGGCATAATAAAGCCAAGAAAGCTGCCGAAGCTCTTGGGACCGCA

GTAAAAGATATTTTAGGAGCAAACAGTGATAATAGGGTTGCATTAGTTACCTATGGTTCAGATATTTTTGAT

GGTAGGAGTGTAGATGTCGTAAAAGGATTTAAAGAAGATGATAAATATTATGGCCTTCAAACTAAGTTCACA

ATTCAGACAGAGAATTATAGTCATAAACAATTAACAAATAATGCTGAAGAGATTATAAAAAGGATTCCGACA

GAAGCTCCTAAAGCTAAGTGGGGATCTACTACCAATGGATTAACTCCAGAGCAACAAAAGGAGTACTATCTT

AGTAAAGTAGGAGAAACATTTACTATGAAAGCCTTCATGGAGGCAGATGATATTTTGAGTCAAGTAAATCGA

AATAGTCAAAAAATTATTGTTCATGTAACTGATGGTGTTCCTACGAGATCATATGCTATTAATAATTTTAAA

CTGGGTGCATCATATGAAAGCCAATTTGAACAAATGAAAAAAAATGGATATCTAAATAAAAGTAATTTTCTA

CTTACTGATAAGCCCGAGGATATAAAAGGAAATGGGGAGAGTTACTTTTTGTTTCCCTTAGATAGTTATCAA

ACACAGATAATCTCTGGAAACTTACAAAAACTTCATTATTTAGATTTAAATCTTAATTACCCTAAAGGTACA

TTTTATCGAAATGGACCAGTAAGAGAACATGGAACACCAACCAAACTTTATATAAATAGTTTAAAACAGAAA

TABLE 11-continued

Amino acid and encoding DNA sequences of gbs1478 proteins derived from different strains of S. agalactiae

AATTATGACATCTTTAATTTTGGTATAGATATATCTGGTTTTAGACAAGTTTATAATGAGGATTATAAGAAA

AATCAAGATGGTACTTTTCAAAAATTGAAAGAGGAAGCTTTTGAACTTTCAGATGGGGAAATAACAGAACTA

ATGAAGTCATTCTCTTCTAAACCTGAGTATTATACCCCGATAGTAACTTCATCCGATGCATCTAACAATGAA

ATTTTATCTAAAATTCAGCAACAATTTGAAAAGATTTTAACAAAAGAAAACTCAATTGTTAATGGAACTATA

GAAGATCCTATGGGTGACAAAATCAATTTACAGCTTGGCAACGGACAAACATTGCAACCAAGTGATTATACT

TTACAGGGAAATGATGGAAGTATAATGAAAGATAGCATTGCAACTGGTGGGCCTAATAATGATGGTGGAATA

CTTAAAGGGGTTAAATTAGAATACATCAAAAATAAACTCTACGTTAGAGGTTTGAACTTAGGGGAGGGACAA

AAAGTAACACTCACATATGATGTGAAACTAGATGACAGTTTTATAAGTAACAAATTCTATGACACTAATGGT

AGAACAACATTGAATCCTAAATCAGAGGATCCTAATACACTTAGAGATTTTCCAATCCCTAAAATTCGTGAT

GTGAGAGAATATCCTACAATAACGATTAAAAACGAGAAGAAGTTAGGTGAAATTGAATTTACAAAAGTTGAT

AAAGATAATAATAAGTTGCTTCTCAAAGGAGCTACGTTTGAACTTCAAGAATTTAATGAAGATTATAAACTT

TATTTACCAATAAAAAATAATAATTCAAAGTAGTGACGGGAGAAAACGGCAAAATTTCTTACAAAGATTTG

AAAGATGGCAAATATCAGTTAATAGAAGCAGTTTCGCCGAAGGATTATCAAAAAATTACTAATAAACCAATT

TTAACTTTTGAAGTTGTTAAAGGATCGATACAAAATATAATAGCTGTTAATAAACAGATTTCTGAATATCAT

GAGGAAGGTGACAAGCATTTAATTACCAACACGCATATTCCACCAAAAGGAATTATTCCGATGACAGGTGGG

AAAGGAATTCTATCTTTCATTTTAATAGGTGGATCTATGATGTCTATTGCAGGTGGAATTTATATTTGGAAA

AGATATAAGAAATCTAGTGATATATCTAGAGAAAAAGATTAA

ORF amino acid sequence (SEQ ID NO: 186):

MRKYQKFSKILTLSLFCLSQIPLNTNVLGESTVPENGAKGKLVVKKTDDQNKPLSKATFVLKTTAHPESKIE

KVTAELTGEATFDNLIPGDYTLSEETAPEGYKKTNQTWQVKVESNGKTTIQNSGDKNSTIGQNQEELDKQYP

PTGIYEDTKESYKLEHVKGSVPNGKSEAKAVNPYSSEGEHIREIPEGTLSKRISEVGDLAHNKYKIELTVSG

KTIVKPVDKQKPLDVVFVLDNSNSMNNDGPNFQRHNKAKKAAEALGTAVKDILGANSDNRVALVTYGSDIFD

GRSVDVVKGFKEDDKYYGLQTKFTIQTENYSHKQLTNNAEEIIKRIPTEAPKAKWGSTTNGLTPEQQKEYYL

SKVGETFTMKAFMEADDILSQVNRNSQKIIVHVTDGVPTRSYAINNFKLGASYESQFEQMKKNGYLNKSNFL

LTDKPEDIKGNGESYFLFPLDSYQTQIISGNLQKLHYLDLNLNYPKGTFYRNGPVREHGTPTKLYINSLKQK

NYDIFNFGIDISGFRQVYNEDYKKNQDGTFQKLKEEAFELSDGEITELMKSFSSKPEYYTPIVTSSDASNNE

ILSKIQQQFEKILTKENSIVNGTIEDPMGDKINLQLGNGQTLQPSDYTLQGNDGSIMKDSIATGGPNNDGGI

LKGVKLEYIKNKLYVRGLNLGEGQKVTLTYDVKLDDSFISNKFYDTNGRTTLNPKSEDPNTLRDFPIPKIRD

VREYPTITIKNEKKLGEIEFTKVDKDNNKLLLKGATFELQEFNEDYKLYLPIKNNNSKVVTGENGKISYKDL

KDGKYQLIEAVSPKDYQKITNKPILTFEVVKGSIQNIIAVNKQISEYHEEGDKHLITNTHIPPKGIIPMTGG

KGILSFILIGGSMMSIAGGIYIWKRYKKSSDISREKD

Strain IC98
ORF DNA sequence (SEQ ID NO: 206):

ATGAAAAAGAGACAAAAATATGGAGAGGGTTATCAGTTACTTTACTAATCCTGTCCCAAATTCCATTTGGT

ATATTGGTACAAGGTGAAACCCAAGATACCAATCAAGCACTTGGAAAAGTAATTGTTAAAAAAACGGGAGAC

AATGCTACACCATTAGGCAAAGCGACTTTTGTGTTAAAAAATGACAATGATAAGTCAGAAACAAGTCACGAA

ACGGTAGAGGGTTCTGGAGAAGCAACCTTTGAAAACATAAAACCTGGAGACTACACATTAAGAGAAGAAACA

GCACCAATTGGTTATAAAAAAACTGATAAAACCTGGAAAGTTAAAGTTGCAGATAACGGAGCAACAATAATC

GAGGGTATGGATGCAGATAAAGCAGAGAAACGAAAAGAAGTTTTGAATGCCCAATATCCAAAATCAGCTATT

TABLE 11-continued

Amino acid and encoding DNA sequences of gbs1478 proteins derived from different strains of *S. agalactiae*

TATGAGGATACAAAAGAAAATTACCCATTAGTTAATGTAGAGGGTTCCAAAGTTGGTGAACAATACAAAGCA
TTGAATCCAATAAATGGAAAAGATGGTCGAAGAGAGATTGCTGAAGGTTGGTTATCAAAAAAAATTACAGGG
GTCAATGATCTCGATAAGAATAAATATAAAATTGAATTAACTGTTGAGGGTAAAACCACTGTTGAAACGAAA
GAACTTAATCAACCACTAGATGTCGTTGTGCTATTAGATAATTCAAATAGTATGAATAATGAAAGAGCCAAT
AATTCTCAAAGAGCATTAAAAGCTGGGGAAGCAGTTGAAAAGCTGATTGATAAAATTACATCAAATAAAGAC
AATAGAGTAGCTCTTGTGACATATGCCTCAACCATTTTTGATGGTACTGAAGCGACCGTATCAAAGGGAGTT
GCCGATCAAAATGGTAAAGCGCTGAATGATAGTGTATCATGGGATTATCATAAAACTACTTTTACAGCAACT
ACACATAATTACAGTTATTTAAATTTAACAAATGATGCTAACGAAGTTAATATTCTAAAGTCAAGAATTCCA
AAGGAAGCGGAGCATATAAATGGGGATCGCACGCTCTATCAATTTGGTGCGACATTTACTCAAAAAGCTCTA
ATGAAAGCAAATGAAATTTTAGAGACACAAAGTTCTAATGCTAGAAAAAAACTTATTTTTCACGTAACTGAT
GGTGTCCCTACGATGTCTTATGCCATAAATTTTAATCCTTATATATCAACATCTTACCAAAACCAGTTTAAT
TCTTTTTTAAATAAAATACCAGATAGAAGTGGTATTCTCCAAGAGGATTTTATAATCAATGGTGATGATTAT
CAAATAGTAAAAGGAGATGGAGAGAGTTTTAAACTGTTTTCGGATAGAAAAGTTCCTGTTACTGGAGGAACG
ACACAAGCAGCTTATCGAGTACCGCAAAATCAACTCTCTGTAATGAGTAATGAGGGATATGCAATTAATAGT
GGATATATTTATCTCTATTGGAGAGATTACAACTGGGTCTATCCATTTGATCCTAAGACAAAGAAAGTTTCT
GCAACGAAACAAATCAAAACTCATGGTGAGCCAACAACATTATACTTTAATGGAAATATAAGACCTAAAGGT
TATGACATTTTTACTGTTGGGATTGGTGTAAACGGAGATCCTGGTGCAACTCCTCTTGAAGCTGAGAAATTT
ATGCAATCAATATCAAGTAAAACAGAAAATTATACTAATGTTGATGATACAAATAAAATTTATGATGAGCTA
AATAAATACTTTAAAACAATTGTTGAGGAAAAACATTCTATTGTTGATGGAAATGTGACTGATCCTATGGGA
GAGATGATTGAATTCCAATTAAAAAATGGTCAAAGTTTTACACATGATGATTACGTTTTGGTTGGAAATGAT
GGCAGTCAATTAAAAAATGGTGTGGCTCTTGGTGGACCAAACAGTGATGGGGAATTTTAAAAGATGTTACA
GTGACTTATGATAAGACATCTCAAACCATCAAAATCAATCATTTGAACTTAGGAAGTGGACAAAAAGTAGTT
CTTACCTATGATGTACGTTTAAAAGATAACTATATAAGTAACAAATTTTACAATACAAATAATCGTACAACG
CTAAGTCCGAAGAGTGAAAAAGAACCAAATACTATTCGTGATTTCCCAATTCCCAAAATTCGTGATGTTCGT
GAGTTTCCGGTACTAACCATCAGTAATCAGAAGAAAATGGGTGAGGTTGAATTTATTAAAGTTAATAAAGAC
AAACATTCAGAATCGCTTTTGGGAGCTAAGTTTCAACTTCAGATAGAAAAAGATTTTTCTGGGTATAAGCAA
TTTGTTCCAGAGGGAAGTGATGTTACAACAAAGAATGATGGTAAAATTTATTTTAAAGCACTTCAAGATGGT
AACTATAAATTATATGAAATTTCAAGTCCAGATGGCTATATAGAGGTTAAAACGAAACCTGTTGTGACATTT
ACAATTCAAAATGGAGAAGTTACGAACCTGAAAGCAGATCCAAATGCTAATAAAAATCAAATCGGGTATCTT
GAAGGAAATGGTAAACATCTTATTACCAACACTCCCAAACGCCCACCAGGTGTTTTTCCTAAAACAGGGGGA
ATTGGTACAATTGTCTATATATTAGTTGGTTCTACTTTTATGATACTTACCATTTGTTCTTTCCGTCGTAAA
CAATTGTAA

ORF amino acid sequence (SEQ ID NO: 187):

MKKRQKIWRGLSVTLLILSQIPFGILVQGETQDTNQALGKVIVKKTGDNATPLGKATFVLKNDNDKSETSHE
TVEGSGEATFENIKPGDYTLREETAPIGYKKTDKTWKVKVADNGATIIEGMDADKAEKRKEVLNAQYPKSAI
YEDTKENYPLVNVEGSKVGEQYKALNPINGKDGRREIAEGWLSKKITGVNDLDKNKYKIELTVEGKTTVETK
ELNQPLDVVVLLDNSNSMNNERANNSQRALKAGEAVEKLIDKITSNKDNRVALVTYASTIFDGTEATVSKGV
ADQNGKALNDSVSWDYHKTTFTATTHNYSYLNLTNDANEVNILKSRIPKEAEHINGDRTLYQFGATFTQKAL

TABLE 11-continued

Amino acid and encoding DNA sequences of gbs1478 proteins derived from different strains of *S. agalactiae*

MKANEILETQSSNARKKLIFHVTDGVPTMSYAINFNPYISTSYQNQFNSFLNKIPDRSGILQEDFIINGDDY

QIVKGDGESFKLFSDRKVPVTGGTTQAAYRVPQNQLSVMSNEGYAINSGYIYLYWRDYNWVYPFDPKTKKVS

ATKQIKTHGEPTTLYFNGNIRPKGYDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGNDSQLKNGVALGGPNSDGGILKDVT

VTYDKTSQTIKINHLNLGSGQKVVLTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQFVPEGSDVTTKNDGKIYFKALQDG

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL

Strain IC105
ORF DNA sequence (SEQ ID NO: 207):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAAACTACTGCTCATCCAGAAAGTAAAATAGAA

AAAGTAACTGCTGAGGTAACAGGTGAAGCTACTTTTGATAATCTCACACCTGGAGATTACACTTTATCAGAA

GAAACGGCACCCGAAGGATACAAAAAGACTACCCAGACTTGGCAAGTTAAGGTTGAGAGTAATGGAAAAACT

ACGATACAAAATAGTGATGATAAAAAATCTATAATTGAACAAGGCAAGAGGAACTAGATAAGCAGTATCCC

CTTACAGGAGCTTATGAAGATACAAAAGAATCTTATAATCTTGAGCATGTTAAAAATTCAATTCCAAATGGG

AAATTAGAGGCAAAAGCAGTTAATCCATATTCAAGTGAAGGTGAGCACATAAGAGAAATTCAAGAGGGAACA

TTATCTAAACGTATTTCAGAAGTAAATGATTTGGATCATAATAAATATAAAATTGAGTTAACTGTTAGCGGT

AAATCCATAATAAAAACTATAAATAAAGATGAACCTCTGGATGTTGTTTTTGTTCTTGATAATTCAAATTCT

ATGAAGAATAATGGAAAAAATAACAAGGCAAAAAGGCAGGTGAAGCAGTAGAAACAATTATAAAAGATGTT

TTAGGAGCAAATGTTGAAAACCGAGCAGCTTTAGTTACTTATGGTTCAGATATTTTTGATGGAAGGACAGTT

AAAGTTATAAAAGGTTTTAAAGAGGATCCTTATTATGGACTTGAAACTAGTTTCACAGTTCAGACAAATGAT

TATAGCTATAAAAAGTTCACTAATATTGCTGCTGATATTATAAAAAAGATCCCTAAAGAAGCTCCAGAAGCT

AAGTGGGGGGGACAAGTCTAGGATTAACTCCAGAAAAAAAGAGGGAATATGATTTAAGTAAAGTAGGTGAG

ACCTTTACAATGAAAGCTTTTATGGAGGCAGATACCTTGTTAAGTAGTATACAGCGTAAGAGTAGAAAGATT

ATTGTTCATCTAACTGACGGTGTTCCAACAAGATCATATGCCATTAATAGTTTTGTAACAGGTTCAACATAC

GCAAATCAATTTGAGAGAATAAAAGAAAAAGGTTATTTAGACAAAAATAATTATTTTATAACTGATGATCCA

GAAAAGATCAAAGGCAATGGGAGAGTTACTTTTTGTTTCCCTTAGATAGTTATCAAACACAGATAATTTCT

GGAAACTTACAAAAACTTCATTATTTAGATTTAAATCTTAATTACCCTAAAGGTACAATTTATAGAAATGGA

CCAGTAAGAGAACATGGAACACCAACCAAACTTTATATAAATAGTTTAAAACAGAAAAATTATGACATCTTT

AATTTTGGTATAGATATATCTGGTTTTAGACAAGTTTATAATGAGGATTATAAGAAAAATCAAGATGGTACT

TTTCAAAAATTGAAGGAGGAAGCTTTTGAACTTTCAGATGGGGAAATAACAGAACTAATGAATTCATTCTCT

TCTAAACCTGAGTATTATACCCCGATAGTAACTTCAGCTGATGTATCTAATAATGAAATTTTATCTAAAATT

CAGCAACAATTTGAAAAGATTTTAACAAAGGAAAACTCAATTGTTAATGGAACTATAGAAGATCCTATGGGT

GATAAAATCAATTTACATCTTGGCAACGGACAAACATTGCAACCAAGTGATTATACTTTACAGGGAAATGAT

GGAAGTATAATGAAAGATAGCATTGCAACTGGAGGGCCTAATAATGATGGTGGGATACTTAAAGGGGTTAAA

TTAGAATACATCAAAAATAAACTCTACGTTAGAGGTTTGAACTTAGGGGAGGGGCAAAAAGTAACACTCACA

TATGATGTGAAACTAGATGACAGTTTTATTAGTAACAAATTCTATGACACTAATGGTAGAACAACATTGAAT

TABLE 11-continued

Amino acid and encoding DNA sequences of gbs1478 proteins derived from different strains of S. agalactiae

CCTAAATCAGAGGAACCCGATACACTTAGAGATTTTCCAATCCCTAAAATTCGTGATGTGAGAGAATATCCT

ACAATAACGATTAAAAACGAGAAGAAGTTAGGTGAAATTGAATTTACAAAAGTTGATAAAGATAATAATAAG

TTGCTTCTCAAAGGAGCTACATTTGAACTTCAAGAATTTAATGAAGATTATAAACTTTATTTACCAATAAAA

AATAATAATTCAAAAGTAGTGACGGGAGAAAACGGCAAAATTTCTTACAAAGATTTGAAAGATGGCAAATAT

CAGTTAATAGAAGCAGTTTCGCCGAAGGATTATCAAAAAATTACTAATAAACCAATTTTAACTTTTGAAGTT

GTTAAAGGATCGATACAAAATATAATAGCTGTTAATAAACAGATTTCTGAATATCATGAGGAAGGTGACAAG

CATTTAATTACCAACACGCATATTCCACCAAAAGGAATTATTCCGATGACAGGTGGGAAAGGAATTCTATCT

TTCATTTTAATAGGTGGAGCTATGATGTCTATTGCAGGTGGAATTTATATTTGGAAAAGACATAAGAAATCT

AGTGATGCATCAATCGAGAAAGATTAA

ORF amino acid sequence (SEQ ID NO: 188):

MRKYQKFSKILTLSLFCLSQIPLNTNVLGESTVPENGAKGKLVVKKTDDQNKPLSKATFVLKTTAHPESKIE

KVTAEVTGEATFDNLTPGDYTLSEETAPEGYKKTTQTWQVKVESNGKTTIQNSDDKKSIIEQRQEELDKQYP

LTGAYEDTKESYNLEHVKNSIPNGKLEAKAVNPYSSEGEHIREIQEGTLSKRISEVNDLDHNKYKIELTVSG

KSIIKTINKDEPLDVVFVLDNSNSMKNNGKNNKAKKAGEAVETIIKDVLGANVENRAALVTYGSDIFDGRTV

KVIKGFKEDPYYGLETSFTVQTNDYSYKKFTNIAADIIKKIPKEAPEAKWGGTSLGLTPEKKREYDLSKVGE

TFTMKAFMEADTLLSSIQRKSRKIIVHLTDGVPTRSYAINSFVTGSTYANQFERIKEKGYLDKNNYFITDDP

EKIKGNGESYFLFPLDSYQTQIISGNLQKLHYLDLNLNYPKGTIYRNGPVREHGTPTKLYINSLKQKNYDIF

NFGIDISGFRQVYNEDYKKNQDGTFQKLKEEAFELSDGEITELMNSFSSKPEYYTPIVTSADVSNNEILSKI

QQQFEKILTKENSIVNGTIEDPMGDKINLHLGNGQTLQPSDYTLQGNDGSIMKDSIATGGPNNDGGILKGVK

LEYIKNKLYVRGLNLGEGQKVTLTYDVKLDDSFISNKFYDTNGRTTLNPKSEEPDTLRDFPIPKIRDVREYP

TITIKNEKKLGEIEFTKVDKDNNKLLLKGATFELQEFNEDYKLYLPIKNNNSKVVTGENGKISYKDLKDGKY

QLIEAVSPKDYQKITNKPILTFEVVKGSIQNIIAVNKQISEYHEEGDKHLITNTHIPPKGIIPMTGGKGILS

FILIGGAMMSIAGGIYIWKRHKKSSDASIEKD

Strain IC108
ORF DNA sequence (SEQ ID NO: 208):

ATGAAAAAGAGACAAAAAATATGGAGAGGGTTATCAGTTACTTTACTAATCCTGTCCCAAATTCCATTTGGT

ATATTGGTACAAGGTGAAACCCAAGATACCAATCAAGCACTTGGAAAAGTAATTGTTAAAAAAACGGGAGAC

AATGCTACACCATTAGGCAAAGCGACTTTTGTGTTAAAAAATGACAATGATAAGTCAGAAACAAGTCACGAA

ACGGTAGAGGGTTCTGGAGAAGCAACCTTTGAAAACATAAAACCTGGAGACTACACATTAAGAGAAGAAACA

GCACCAATTGGTTATAAAAAAACTGATAAAACCTGGAAAGTTAAAGTTGCAGATAACGGAGCAACAATAATC

GAGGGTATGGATGCAGATAAAGCAGAGAAACGAAAAGAAGTTTTGAATGCCCAATATCCAAAATCAGCTATT

TATGAGGATACAAAAGAAATTACCCATTAGTTAATGTAGAGGGTTCCAAAGTTGGTGAACAATACAAAGCA

TTGAATCCAATAAATGGAAAAGATGGTCGAAGAGAGATTGCTGAAGGTTGGTTATCAAAAAAATTACAGGG

GTCAATGATCTCGATAAGAATAAATATAAAATTGAATTAACTGTTGAGGGTAAAACCACTGTTGAAACGAAA

GAACTTAATCAACCACTAGATGTCGTTGTGCTATTAGATAATTCAAATAGTATGAATAATGAAAGAGCCAAT

AATTCTCAAAGAGCATTAAAAGCTGGGGAAGCAGTTGAAAAGCTGATTGATAAAATTACATCAAATAAAGAC

AATAGAGTAGCTCTTGTGACATATGCCTCAACCATTTTTGATGGTACTGAAGCGACCGTATCAAAGGGAGTT

GCCGATCAAAATGGTAAAGCGCTGAATGATAGTGTATCATGGGATTATCATAAAACTACTTTTACAGCAACT

ACACATAATTACAGTTATTTAAATTTAACAAATGATGCTAACGAAGTTAATATTCTAAAGTCAAGAATTCCA

TABLE 11-continued

Amino acid and encoding DNA sequences of gbs1478 proteins derived from different strains of S. agalactiae

AAGGAAGCGGAGCATATAAATGGGGATCGCACGCTCTATCAATTTGGTGCGACATTTACTCAAAAAGCTCTA

ATGAAAGCAAATGAAATTTTAGAGACACAAAGTTCTAATGCTAGAAAAAAACTTATTTTTCACGTAACTGAT

GGTGTCCCTACGATGTCTTATGCCATAAATTTTAATCCTTATATATCAACATCTTACCAAAACCAGTTTAAT

TCTTTTTTAAATAAAATACCAGATAGAAGTGGTATTCTCCAAGAGGATTTTATAATCAATGGTGATGATTAT

CAAATAGTAAAAGGAGATGGAGAGAGTTTTAAACTGTTTTCGGATAGAAAAGTTCCTGTTACTGGAGGAACG

ACACAAGCAGCTTATCGAGTACCGCAAAATCAACTCTCTGTAATGAGTAATGAGGGATATGCAATTAATAGT

GGATATATTTATCTCTATTGGAGAGATTACAACTGGGTCTATCCATTTGATCCTAAGACAAAGAAAGTTTCT

GCAACGAAACAAATCAAAACTCATGGTGAGCCAACAACATTATACTTTAATGGAAATATAAGACCTAAAGGT

TATGACATTTTTACTGTTGGGATTGGTGTAAACGGAGATCCTGGTGCAACTCCTCTTGAAGCTGAGAAATTT

ATGCAATCAATATCAAGTAAAACAGAAAATTATACTAATGTTGATGATACAAATAAAATTTATGATGAGCTA

AATAAATACTTTAAAACAATTGTTGAGGAAAAACATTCTATTGTTGATGGAAATGTGACTGATCCTATGGGA

GAGATGATTGAATTCCAATTAAAAAATGGTCAAAGTTTTACACATGATGATTACGTTTTGGTTGGAAATGAT

GGCAGTCAATTAAAAAATGGTGTGGCTCTTGGTGGACCAAACAGTGATGGGGGAATTTTAAAAGATGTTACA

GTGACTTATGATAAGACATCTCAAACCATCAAAATCAATCATTTGAACTTAGGAAGTGGACAAAAAGTAGTT

CTTACCTATGATGTACGTTTAAAAGATAACTATATAAGTAACAAATTTTACAATACAAATAATCGTACAACG

CTAAGTCCGAAGAGTGAAAAAGAACCAAATACTATTCGTGATTTCCCAATTCCCAAAATTCGTGATGTTCGT

GAGTTTCCGGTACTAACCATCAGTAATCAGAAGAAAATGGGTGAGGTTGAATTTATTAAAGTTAATAAAGAC

AAACATTCAGAATCGCTTTTGGGAGCTAAGTTTCAACTTCAGATAGAAAAAGATTTTTCTGGGTATAAGCAA

TTTGTTCCAGAGGGAAGTGATGTTACAACAAAGAATGATGGTAAAATTTATTTTAAAGCACTTCAAGATGGT

AACTATAAATTATATGAAATTTCAAGTCCAGATGGCTATATAGAGGTTAAAACGAAACCTGTTGTGACATTT

ACAATTCAAATGGAGAAGTTACGAACCTGAAAGCAGATCCAAATGCTAATAAAAATCAAATCGGGTATCTT

GAAGGAAATGGTAAACATCTTATTACCAACACTCCCAAACGCCCACCAGGTGTTTTTCCTAAAACAGGGGGA

ATTGGTACAATTGTCTATATATTAGTTGGTTCTACTTTTATGATACTTACCATTTGTTCTTTCCGTCGTAAA

CAATTGTAA

ORF amino acid sequence (SEQ ID NO: 189):

MKKRQKIWRGLSVTLLILSQIPFGILVQGETQDTNQALGKVIVKKTGDNATPLGKATFVLKNDNDKSETSHE

TVEGSGEATFENIKPGDYTLREETAPIGYKKTDKTWKVKVADNGATIIEGMDADKAEKRKEVLNAQYPKSAI

YEDTKENYPLVNVEGSKVGEQYKALNPINGKDGRREIAEGWLSKKITGVNDLDKNKYKIELTVEGKTTVETK

ELNQPLDVVVLLDNSNSMNNERANNSQRALKAGEAVEKLIDKITSNKDNRVALVTYASTIFDGTEATVSKGV

ADQNGKALNDSVSWDYHKTTFTATTHNYSYLNLTNDANEVNILKSRIPKEAEHINGDRTLYQFGATFTQKAL

MKANEILETQSSNARKKLIFHVTDGVPTMSYAINFNPYISTSYQNQFNSFLNKIPDRSGILQEDFIINGDDY

QIVKGDGESFKLFSDRKVPVTGGTTQAAYRVPQNQLSVMSNEGYAINSGYIYLYWRDYNWVYPFDPKTKKVS

ATKQIKTHGEPTTLYFNGNIRPKGYDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGNDSQLKNGVALGGPNSDGGILKDVT

VTYDKTSQTIKINHLNLGSGQKVVLTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQFVPEGSDVTTKNDGKIYFKALQDG

TABLE 11-continued

Amino acid and encoding DNA sequences of gbs1478 proteins derived from different strains of *S. agalactiae*

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL

Strain IC216
ORF DNA sequence (SEQ ID NO: 209):

ATGAAAAAGAGACAAAAAATATGGAGAGGGTTATCAGTTACTTTACTAATCCTGTCCCAAATTCCATTTGGT

ATATTGGTACAAGGTGAAACCCAAGATACCAATCAAGCACTTGGAAAAGTAATTGTTAAAAAAACGGGAGAC

AATGCTACACCATTAGGCAAAGCGACTTTTGTGTTAAAAAATGACAATGATAAGTCAGAAACAAGTCACGAA

ACGGTAGAGGGTTCTGGAGAAGCAACCTTTGAAAACATAAAACCTGGAGACTACACATTAAGAGAAGAAACA

GCACCAATTGGTTATAAAAAAACTGATAAAACCTGGAAAGTTAAAGTTGCAGATAACGGAGCAACAATAATC

GAGGGTATGGATGCAGATAAAGCAGAGAAACGAAAAGAAGTTTTGAATGCCCAATATCCAAAATCAGCTATT

TATGAGGATACAAAAGAAAATTACCCATTAGTTAATGTAGAGGGTTCCAAAGTTGGTGAACAATACAAAGCA

TTGAATCCAATAAATGGAAAAGATGGTCGAAGAGAGATTGCTGAAGGTTGGTTATCAAAAAAAATTACAGGG

GTCAATGATCTCGATAAGAATAAATATAAAATTGAATTAACTGTTGAGGGTAAAACCACTGTTGAAACGAAA

GAACTTAATCAACCACTAGATGTCGTTGTGCTATTAGATAATTCAAATAGTATGAATAATGAAAGAGCCAAT

AATTCTCAAAGAGCATTAAAAGCTGGGGAAGCAGTTGAAAAGCTGATTGATAAAATTACATCAAATAAAGAC

AATAGAGTAGCTCTTGTGACATATGCCTCAACCATTTTTGATGGTACTGAAGCGACCGTATCAAAGGGAGTT

GCCGATCAAAATGGTAAAGCGCTGAATGATAGTGTATCATGGGATTATCATAAAACTACTTTTACAGCAACT

ACACATAATTACAGTTATTTAAATTTAACAAATGATGCTAACGAAGTTAATATTCTAAAGTCAAGAATTCCA

AAGGAAGCGGAGCATATAAATGGGGATCGCACGCTCTATCAATTTGGTGCGACATTTACTCAAAAAGCTCTA

ATGAAAGCAAATGAAATTTTAGAGACACAAAGTTCTAATGCTAGAAAAAAACTTATTTTTCACGTAACTGAT

GGTGTCCCTACGATGTCTTATGCCATAAAATTTTAATCCTTATATATCAACATCTTACCAAAACCAGTTTAAT

TCTTTTTTAAATAAAATACCAGATAGAAGTGGTATTCTCCAAGAGGATTTTATAATCAATGGTGATGATTAT

CAAATAGTAAAAGGAGATGGAGAGAGTTTTAAACTGTTTTCGGATAGAAAAGTTCCTGTTACTGGAGGAACG

ACACAAGCAGCTTATCGAGTACCGCAAAATCAACTCTCTGTAATGAGTAATGAGGGATATGCAATTAATAGT

GGATATATTTATCTCTATTGGAGAGATTACAACTGGGTCTATCCATTTGATCCTAAGACAAAGAAAGTTTCT

GCAACGAAACAAATCAAAACTCATGGTGAGCCAACAACATTATACTTTAATGGAAATATAAGACCTAAAGGT

TATGACATTTTTACTGTTGGGATTGGTGTAAACGGAGATCCTGGTGCAACTCCTCTTGAAGCTGAGAAATTT

ATGCAATCAATATCAAGTAAAACAGAAAATTATACTAATGTTGATGATACAAATAAAATTTATGATGAGCTA

AATAAATACTTTAAAACAATTGTTGAGGAAAAACATTCTATTGTTGATGGAAATGTGACTGATCCTATGGGA

GAGATGATTGAATTCCAATTAAAAAATGGTCAAAGTTTTACACATGATGATTACGTTTTGGTTGGAAATGAT

GGCAGTCAATTAAAAAATGGTGTGGCTCTTGGTGGACCAAACAGTGATGGGGAATTTTAAAAGATGTTACA

GTGACTTATGATAAGACATCTCAAACCATCAAAATCAATCATTTGAACTTAGGAAGTGGACAAAAAGTAGTT

CTTACCTATGATGTACGTTAAAAGATAACTATATAAGTAACAAATTTTACAATACAAATAATCGTACAACG

CTAAGTCCGAAGAGTGAAAAAGAACCAAATACTATTCGTGATTTCCCAATTCCCAAAATTCGTGATGTTCGT

GAGTTTCCGGTACTAACCATCAGTAATCAGAAGAAAATGGGTGAGGTTGAATTTATTAAAGTTAATAAAGAC

AAACATTCAGAATCGCTTTTGGGAGCTAAGTTTCAACTTCAGATAGAAAAGATTTTTCTGGGTATAAGCAA

TTTGTTCCAGAGGGAAGTGATGTTACAACAAAGAATGATGGTAAAATTTATTTTAAAGCACTTCAAGATGGT

AACTATAAATTATATGAAATTTCAAGTCCAGATGGCTATATAGAGGTTAAAACGAAACCTGTTGTGACATTT

ACAATTCAAAATGGAGAAGTTACGAACCTGAAAGCAGATCCAAATGCTAATAAAAATCAAATCGGGTATCTT

TABLE 11-continued

Amino acid and encoding DNA sequences of gbs1478 proteins derived from different strains of *S. agalactiae*

GAAGGAAATGGTAAACATCTTATTACCAACACTCCCAAACGCCCACCAGGTGTTTTTCCTAAAACAGGGGGA

ATTGGTACAATTGTCTATATATTAGTTGGTTCTACTTTTATGATACTTACCATTTGTTCTTTCCGTCGTAAA

CAATTGTAA

ORF amino acid sequence (SEQ ID NO: 190):

MKKRQKIWRGLSVTLLILSQIPFGILVQGETQDTNQALGKVIVKKTGDNATPLGKATFVLKNDNDKSETSHE

TVEGSGEATFENIKPGDYTLREETAPIGYKKTDKTWKVKVADNGATIIEGMDADKAEKRKEVLNAQYPKSAI

YEDTKENYPLVNVEGSKVGEQYKALNPINGKDGRREIAEGWLSKKITGVNDLDKNKYKIELTVEGKTTVETK

ELNQPLDVVVLLDNSNSMNNERANNSQRALKAGEAVEKLIDKITSNKDNRVALVTYASTIFDGTEATVSKGV

ADQNGKALNDSVSWDYHKTTFTATTHNYSYLNLTNDANEVNILKSRIPKEAEHINGDRTLYQFGATFTQKAL

MKANEILETQSSNARKKLIFHVTDGVPTMSYAINFNPYISTSYQNQFNSFLNKIPDRSGILQEDFIINGDDY

QIVKGDGESFKLFSDRKVPVTGGTTQAAYRVPQNQLSVMSNEGYAINSGYIYLYWRDYNWVYPFDPKTKKVS

ATKQIKTHGEPTTLYFNGNIRPKGYDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGNDGSQLKNGVALGGPNSDGGILKDVT

VTYDKTSQTIKINHLNLGSGQKVVLTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQFVPEGSDVTTKNDGKIYFKALQDG

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL

Strain IC244
ORF DNA sequence (SEQ ID NO: 210):

ATGAAAAAGAGACAAAAAATATGGAGAGGGTTATCAGTTACTTTACTAATCCTGTCCCAAATTCCATTTGGT

ATATTGGTACAAGGTGAAACCCAAGATACCAATCAAGCACTTGGAAAAGTAATTGTTAAAAAAACGGGAGAC

AATGCTACACCATTAGGCAAAGCGACTTTTGTGTTAAAAAATGACAATGATAAGTCAGAAACAAGTCACGAA

ACGGTAGAGGGTTCTGGAGAAGCAACCTTTGAAAACATAAAACCTGGAGACTACACATTAAGAGAAGAAACA

GCACCAATTGGTTATAAAAAAACTGATAAAACCTGGAAAGTTAAAGTTGCAGATAACGGAGCAACAATAATC

GAGGGTATGGATGCAGATAAAGCAGAGAAACGAAAAGAAGTTTTGAATGCCCAATATCCAAAATCAGCTATT

TATGAGGATACAAAAGAAAATTACCCATTAGTTAATGTAGAGGGTTCCAAAGTTGGTGAACAATACAAAGCA

TTGAATCCAATAAATGGAAAAGATGGTCGAAGAGAGATTGCTGAAGGTTGGTTATCAAAAAAAATTACAGGG

GTCAATGATCTCGATAAGAATAAATATAAAATTGAATTAACTGTTGAGGGTAAAACCACTGTTGAAACGAAA

GAACTTAATCAACCACTAGATGTCGTTGTGCTATTAGATAATTCAAATAGTATGAATAATGAAAGAGCCAAT

AATTCTCAAAGAGCATTAAAAGCTGGGGAAGCAGTTGAAAAGCTGATTGATAAAATTACATCAAATAAAGAC

AATAGAGTAGCTCTTGTGACATATGCCTCAACCATTTTTGATGGTACTGAAGCGACCGTATCAAAGGGAGTT

GCCGATCAAAATGGTAAAGCGCTGAATGATAGTGTATCATGGGATTATCATAAAACTACTTTTACAGCAACT

ACACATAATTACAGTTATTTAAATTTAACAAATGATGCTAACGAAGTTAATATTCTAAAGTCAAGAATTCCA

AAGGAAGCGGAGCATATAAATGGGGATCGCACGCTCTATCAATTTGGTGCGACATTTACTCAAAAAGCTCTA

ATGAAAGCAAATGAAATTTTAGAGACACAAAGTTCTAATGCTAGAAAAAAACTTATTTTTCACGTAACTGAT

GGTGTCCCTACGATGTCTTATGCCATAAATTTTAATCCTTATATATCAACATCTTACCAAAACCAGTTTAAT

TCTTTTTTAAATAAAATACCAGATAGAAGTGGTATTCTCCAAGAGGATTTTATAATCAATGGTGATGATTAT

CAAATAGTAAAGGAGATGGAGAGAGTTTTAAACTGTTTTCGGATAGAAAAGTTCCTGTTACTGGAGGAACG

ACACAAGCAGCTTATCGAGTACCGCAAAATCAACTCTCTGTAATGAGTAATGAGGGATATGCAATTAATAGT

TABLE 11-continued

Amino acid and encoding DNA sequences of gbs1478 proteins derived from different strains of *S. agalactiae*

```
GGATATATTTATCTCTATTGGAGAGATTACAACTGGGTCTATCCATTTGATCCTAAGACAAAGAAAGTTTCT

GCAACGAAACAAATCAAAACTCATGGTGAGCCAACAACATTATACTTTAATGGAAATATAAGACCTAAAGGT

TATGACATTTTTACTGTTGGGATTGGTGTAAACGGAGATCCTGGTGCAACTCCTCTTGAAGCTGAGAAATTT

ATGCAATCAATATCAAGTAAAACAGAAAATTATACTAATGTTGATGACAAATAAAATTTATGATGAGCTA

AATAAATACTTTAAAACAATTGTTGAGGAAAAACATTCTATTGTTGATGGAAATGTGACTGATCCTATGGGA

GAGATGATTGAATTCCAATTAAAAAATGGTCAAAGTTTTACACATGATGATTACGTTTTGGTTGGAAATGAT

GGCAGTCAATTAAAAAATGGTGTGGCTCTTGGTGGACCAAACAGTGATGGGGAATTTTAAAAGATGTTACA

GTGACTTATGATAAGACATCTCAAACCATCAAAATCAATCATTTGAACTTAGGAAGTGGACAAAAAGTAGTT

CTTACCTATGATGTACGTTTAAAAGATAACTATATAAGTAACAAATTTTACAATACAATAATCGTACAACG

CTAAGTCCGAAGAGTGAAAAAGAACCAAATACTATTCGTGATTTCCCAATTCCCAAAATTCGTGATGTTCGT

GAGTTTCCGGTACTAACCATCAGTAATCAGAAGAAAATGGGTGAGGTTGAATTTATTAAAGTTAATAAAGAC

AAACATTCAGAATCGCTTTTGGGAGCTAAGTTTCAACTTCAGATAGAAAAGATTTTTCTGGGTATAAGCAA

TTTGTTCCAGAGGGAAGTGATGTTACAACAAAGAATGATGGTAAAATTTATTTTAAAGCACTTCAAGATGGT

AACTATAAATTATATGAAATTTCAAGTCCAGATGGCTATATAGAGGTTAAAACGAAACCTGTTGTGACATTT

ACAATTCAAAATGGAGAAGTTACGAACCTGAAAGCAGATCCAAATGCTAATAAAAATCAAATCGGGTATCTT

GAAGGAAATGGTAAACATCTTATTACCAACACTCCCAAACGCCCACCAGGTGTTTTTCCTAAAACAGGGGGA

ATTGGTACAATTGTCTATATATTAGTTGGTTCTACTTTTATGATACTTACCATTTGTTCTTTCCGTCGTAAA

CAATTGTAA
```

ORF amino acid sequence (SEQ ID NO: 191):

```
MKKRQKIWRGLSVTLLILSQIPFGILVQGETQDTNQALGKVIVKKTGDNATPLGKATFVLKNDNDKSETSHE

TVEGSGEATFENIKPGDYTLREETAPIGYKKTDKTWKVKVADNGATIIEGMDADKAEKRKEVLNAQYPKSAI

YEDTKENYPLVNVEGSKVGEQYKALNPINGKDGRREIAEGWLSKKITGVNDLDKNKYKIELTVEGKTTVETK

ELNQPLDVVVLLDNSNSMNNERANNSQRALKAGEAVEKLIDKITSNKDNRVALVTYASTIFDGTEATVSKGV

ADQNGKALNDSVSWDYHKTTFTATTHNYSYLNLTNDANEVNILKSRIPKEAEHINGDRTLYQFGATFTQKAL

MKANEILETQSSNARKKLIFHVTDGVPTMSYAINFNPYISTSYQNQFNSFLNKIPDRSGILQEDFIINGDDY

QIVKGDGESFKLFSDRKVPVTGGTTQAAYRVPQNQLSVMSNEGYAINSGYIYLYWRDYNWVYPFDPKTKKVS

ATKQIKTHGEPTTLYFNGNIRPKGYDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGNDGSQLKNGVALGGPNSDGGILKDVT

VTYDKTSQTIKINHLNLGSGQKVVLTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQFVPEGSDVTTKNDGKIYFKALQDG

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL
```

Strain IC245
ORF DNA sequence (SEQ ID NO: 211):

```
ATGAAAAAGAGACAAAAATATGGAGAGGGTTATCAGTTACTTTACTAATCCTGTCCCAAATTCCATTTGGT

ATATTGGTACAAGGTGAAACCCAAGATACCAATCAAGCACTTGGAAAAGTAATTGTTAAAAAAACGGGAGAC

AATGCTACACCATTAGGCAAAGCGACTTTTGTGTTAAAAAATGACAATGATAAGTCAGAAACAAGTCACGAA

ACGGTAGAGGGTTCTGGAGAAGCAACCTTTGAAAACATAAAACCTGGAGACTACACATTAAGAGAAGAAACA

GCACCAATTGGTTATAAAAAAACTGATAAAACCTGGAAAGTTAAAGTTGCAGATAACGGAGCAACAATAATC
```

TABLE 11-continued

Amino acid and encoding DNA sequences of gbs1478 proteins derived from different strains of *S. agalactiae*

GAGGGTATGGATGCAGATAAAGCAGAGAAACGAAAAGAAGTTTTGAATGCCCAATATCCAAAATCAGCTATT

TATGAGGATACAAAAGAAAATTACCCATTAGTTAATGTAGAGGGTTCCAAAGTTGGTGAACAATACAAAGCA

TTGAATCCAATAAATGGAAAAGATGGTCGAAGAGAGATTGCTGAAGGTTGGTTATCAAAAAAAATTACAGGG

GTCAATGATCTCGATAAGAATAAATATAAAATTGAATTAACTGTTGAGGGTAAAACCACTGTTGAAACGAAA

GAACTTAATCAACCACTAGATGTCGTTGTGCTATTAGATAATTCAAATAGTATGAATAATGAAAGAGCCAAT

AATTCTCAAAGAGCATTAAAAGCTGGGGAAGCAGTTGAAAAGCTGATTGATAAAATTACATCAAATAAAGAC

AATAGAGTAGCTCTTGTGACATATGCCTCAACCATTTTTGATGGTACTGAAGCGACCGTATCAAAGGGAGTT

GCCGATCAAAATGGTAAAGCGCTGAATGATAGTGTATCATGGGATTATCATAAAACTACTTTTACAGCAACT

ACACATAATTACAGTTATTTAAATTTAACAAATGATGCTAACGAAGTTAATATTCTAAAGTCAAGAATTCCA

AAGGAAGCGGAGCATATAAATGGGGATCGCACGCTCTATCAATTTGGTGCGACATTTACTCAAAAAGCTCTA

ATGAAAGCAAATGAAATTTTAGAGACACAAAGTTCTAATGCTAGAAAAAAACTTATTTTTCACGTAACTGAT

GGTGTCCCTACGATGTCTTATGCCATAAAATTTTAATCCTTATATATCAACATCTTACCAAAACCAGTTTAAT

TCTTTTTTAAATAAAATACCAGATAGAAGTGGTATTCTCCAAGAGGATTTTATAATCAATGGTGATGATTAT

CAAATAGTAAAAGGAGATGGAGAGAGTTTTAAACTGTTTTCGGATAGAAAAGTTCCTGTTACTGGAGGAACG

ACACAAGCAGCTTATCGAGTACCGCAAAATCAACTCTCTGTAATGAGTAATGAGGGATATGCAATTAATAGT

GGATATATTTATCTCTATTGGAGAGATTACAACTGGGTCTATCCATTTGATCCTAAGACAAAGAAAGTTTCT

GCAACGAAACAAATCAAAACTCATGGTGAGCCAACAACATTATACTTTAATGGAAATATAAGACCTAAAGGT

TATGACATTTTTACTGTTGGGATTGGTGTAAACGGAGATCCTGGTGCAACTCCTCTTGAAGCTGAGAAATTT

ATGCAATCAATATCAAGTAAAACAGAAAATTATACTAATGTTGATGATACAAATAAAATTTATGATGAGCTA

AATAAATACTTTAAAACAATTGTTGAGGAAAAACATTCTATTGTTGATGGAAATGTGACTGATCCTATGGGA

GAGATGATTGAATTCCAATTAAAAAATGGTCAAAGTTTTACACATGATGATTACGTTTTGGTTGGAAATGAT

GGCAGTCAATTAAAAAATGGTGTGGCTCTTGGTGGACCAAACAGTGATGGGGAATTTTAAAAGATGTTACA

GTGACTTATGATAAGACATCTCAAACCATCAAAATCAATCATTTGAACTTAGGAAGTGGACAAAAAGTAGTT

CTTACCTATGATGTACGTTTAAAAGATAACTATATAAGTAACAAATTTTACAATACAAATAATCGTACAACG

CTAAGTCCGAAGAGTGAAAAAGAACCAAATACTATTCGTGATTTCCCAATTCCCAAAATTCGTGATGTTCGT

GAGTTTCCGGTACTAACCATCAGTAATCAGAAGAAAATGGGTGAGGTTGAATTTATTAAAGTTAATAAAGAC

AAACATTCAGAATCGCTTTTGGGAGCTAAGTTTCAACTTCAGATAGAAAAAGATTTTTCTGGGTATAAGCAA

TTTGTTCCAGAGGGAAGTGATGTTACAACAAAGAATGATGGTAAAATTTATTTTAAAGCACTTCAAGATGGT

AACTATAAATTATATGAAATTTCAAGTCCAGATGGCTATATAGAGGTTAAAACGAAACCTGTTGTGACATTT

ACAATTCAAAATGGAGAAGTTACGAACCTGAAAGCAGATCCAAATGCTAATAAAAATCAAATCGGGTATCTT

GAAGGAAATGGTAAACATCTTATTACCAACACTCCCAAACGCCCACCAGGTGTTTTTCCTAAAACAGGGGGA

ATTGGTACAATTGTCTATATATTAGTTGGTTCTACTTTTATGATACTTACCATTTGTTCTTTCCGTCGTAAA

CAATTGTAA

ORF amino acid sequence (SEQ ID NO: 192):

MKKRQKIWRGLSVTLLILSQIPFGILVQGETQDTNQALGKVIVKKTGDNATPLGKATFVLKNDNDKSETSHE

TVEGSGEATFENIKPGDYTLREETAPIGYKKTDKTWKVKVADNGATIIEGMDADKAEKRKEVLNAQYPKSAI

YEDTKENYPLVNVEGSKVGEQYKALNPINGKDGRREIAEGWLSKKITGVNDLDKNKYKIELTVEGKTTVETK

ELNQPLDVVVLLDNSNSMNNERANNSQRALKAGEAVEKLIDKITSNKDNRVALVTYASTIFDGTEATVSKGV

TABLE 11-continued

Amino acid and encoding DNA sequences of gbs1478 proteins derived from
different strains of *S. agalactiae*

ADQNGKALNDSVSWDYHKTTFTATTHNYSYLNLTNDANEVNILKSRIPKEAEHINGDRTLYQFGATFTQKAL

MKANEILETQSSNARKKLIFHVTDGVPTMSYAINFNPYISTSYQNQFNSFLNKIPDRSGILQEDFIINGDDY

QIVKGDGESFKLFSDRKVPVTGGTTQAAYRVPQNQLSVMSNEGYAINSGYIYLYWRDYNWVYPFDPKTKKVS

ATKQIKTHGEPTTLYFNGNIRPKGYDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGNDGSQLKNGVALGGPNSDGGILKDVT

VTYDKTSQTIKINHLNLGSGQKVVLTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQFVPEGSDVTTKNDGKIYFKALQDG

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL

Strain IC246
ORF DNA sequence (SEQ ID NO: 212):

ATGAAAAAGAGACAAAAAATATGGAGAGGGTTATCAGTTACTTTACTAATCCTGTCCCAAATTCCATTTGGT

ATATTGGTACAAGGTGAAACCCAAGATACCAATCAAGCACTTGGAAAAGTAATTGTTAAAAAAACGGGAGAC

AATGCTACACCATTAGGCAAAGCGACTTTTGTGTTAAAAAATGACAATGATAAGTCAGAAACAAGTCACGAA

ACGGTAGAGGGTTCTGGAGAAGCAACCTTTGAAAACATAAAACCTGGAGACTACACATTAAGAGAAGAAACA

GCACCAATTGGTTATAAAAAAACTGATAAAACCTGGAAAGTTAAAGTTGCAGATAACGGAGCAACAATAATC

GAGGGTATGGATGCAGATAAAGCAGAGAAACGAAAAGAAGTTTTGAATGCCCAATATCCAAAATCAGCTATT

TATGAGGATACAAAAGAAAATTACCCATTAGTTAATGTAGAGGGTTCCAAAGTTGGTGAACAATACAAAGCA

TTGAATCCAATAAATGGAAAAGATGGTCGAAGAGAGATTGCTGAAGGTTGGTTATCAAAAAAAAATACAGGG

GTCAATGATCTCGATAAGAATAAATATAAAATTGAATTAACTGTTGAGGGTAAAACCACTGTTGAAACGAAA

GAACTTAATCAACCACTAGATGTCGTTGTGCTATTAGATAATTCAAATAGTATGAATAATGAAAGAGCCAAT

AATTCTCAAAGAGCATTAAAAGCTGGGGAAGCAGTTGAAAAGCTGATTGATAAAATTACATCAAATAAAGAC

AATAGAGTAGCTCTTGTGACATATGCCTCAACCATTTTTGATGGTACTGAAGCGACCGTATCAAAGGGAGTT

GCCGATCAAAATGGTAAAGCGCTGAATGATAGTGTATCATGGGATTATCATAAAACTACTTTTACAGCAACT

ACACATAATTACAGTTATTTAAATTTAACAAATGATGCTAACGAAGTTAATATTCTAAAGTCAAGAATTCCA

AAGGAAGCGGAGCATATAAATGGGATCGCACGCTCTATCAATTTGGTGCGACATTTACTCAAAAAGCTCTA

ATGAAAGCAAATGAATTTTAGAGACACAAAGTTCTAATGCTAGAAAAAAACTTATTTTTCACGTAACTGAT

GGTGTCCCTACGATGTCTTATGCCATAAATTTTAATCCTTATATATCAACATCTTACCAAAACCAGTTTAAT

TCTTTTTTAAATAAAATACCAGATAGAAGTGGTATTCTCCAAGAGGATTTTATAATCAATGGTGATGATTAT

CAAATAGTAAAAGGAGATGGAGAGAGTTTTAAACTGTTTTCGGATAGAAAAGTTCCTGTTACTGGAGGAACG

ACACAAGCAGCTTATCGAGTACCGCAAAATCAACTCTCTGTAATGAGTAATGAGGGATATGCAATTAATAGT

GGATATATTTATCTCTATTGGAGAGATTACAACTGGGTCTATCCATTTGATCCTAAGACAAAGAAAGTTTCT

GCAACGAAACAAATCAAAACTCATGGTGAGCCAACAACATTATACTTTAATGGAAATATAAGACCTAAAGGT

TATGACATTTTTACTGTTGGGATTGGTGTAAACGGAGATCCTGGTGCAACTCCTCTTGAAGCTGAGAAATTT

ATGCAATCAATATCAAGTAAAACAGAAAATTATACTAATGTTGATGATACAAATAAAATTTATGATGAGCTA

AATAAATACTTTAAAACAATTGTTGAGGAAAAACATTCTATTGTTGATGGAAATGTGACTGATCCTATGGGA

GAGATGATTGAATTCCAATTAAAAAATGGTCAAAGTTTTACACATGATGATTACGTTTTGGTTGGAAATGAT

GGCAGTCAATTAAAAAATGGTGTGGCTCTTGGTGGACCAAACAGTGATGGGGAATTTAAAAGATGTTACA

GTGACTTATGATAAGACATCTCAAACCATCAAAATCAATCATTTGAACTTAGGAAGTGGACAAAAAGTAGTT

TABLE 11-continued

Amino acid and encoding DNA sequences of gbs1478 proteins derived from different strains of *S. agalactiae*

CTTACCTATGATGTACGTTTAAAAGATAACTATATAAGTAACAAATTTTACAATACAAATAATCGTACAACG

CTAAGTCCGAAGAGTGAAAAAGAACCAAATACTATTCGTGATTTCCCAATTCCCAAAATTCGTGATGTTCGT

GAGTTTCCGGTACTAACCATCAGTAATCAGAAGAAAATGGGTGAGGTTGAATTTATTAAAGTTAATAAAGAC

AAACATTCAGAATCGCTTTTGGGAGCTAAGTTTCAACTTCAGATAGAAAAAGATTTTTCTGGGTATAAGCAA

TTTGTTCCAGAGGGAAGTGATGTTACAACAAAGAATGATGGTAAAATTTATTTTAAAGCACTTCAAGATGGT

AACTATAAATTATATGAAATTTCAAGTCCAGATGGCTATATAGAGGTTAAAACGAAACCTGTTGTGACATTT

ACAATTCAAAATGGAGAAGTTACGAACCTGAAAGCAGATCCAAATGCTAATAAAAATCAAATCGGGTATCTT

GAAGGAAATGGTAAACATCTTATTACCAACACTCCCAAACGCCCACCAGGTGTTTTTCCTAAAACAGGGGGA

ATTGGTACAATTGTCTATATATTAGTTGGTTCTACTTTTATGATACTTACCATTTGTTCTTTCCGTCGTAAA

CAATTGTAA

ORF amino acid sequence (SEQ ID NO: 193):

MKKRQKIWRGLSVTLLILSQIPFGILVQGETQDTNQALGKVIVKKTGDNATPLGKATFVLKNDNDKSETSHE

TVEGSGEATFENIKPGDYTLREETAPIGYKKTDKTWKVKVADNGATIIEGMDADKAEKRKEVLNAQYPKSAI

YEDTKENYPLVNVEGSKVGEQYKALNPINGKDGRREIAEGWLSKKNTGVNDLDKNKYKIELTVEGKTTVETK

ELNQPLDVVVLLDNSNSMNNERANNSQRALKAGEAVEKLIDKITSNKDNRVALVTYASTIFDGTEATVSKGV

ADQNGKALNDSVSWDYHKTTFTATTHNYSYLNLTNDANEVNILKSRIPKEAEHINGDRTLYQFGATFTQKAL

MKANEILETQSSNARKKLIFHVTDGVPTMSYAINFNPYISTSYQNQFNSFLNKIPDRSGILQEDFIINGDDY

QIVKGDGESFKLFSDRKVPVTGGTTQAAYRVPQNQLSVMSNEGYAINSGYIYLYWRDYNWVYPFDPKTKKVS

ATKQIKTHGEPTTLYFNGNIRPKGYDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGNDGSQLKNGVALGGPNSDGGILKDVT

VTYDKTSQTIKINHLNLGSGQKVVLTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQFVPEGSDVTTKNDGKIYFKALQDG

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL

Strain IC247
ORF DNA sequence (SEQ ID NO: 213):

ATGAAAAAGAGACAAAAAATATGGAGAGGGTTATCAGTTACTTTACTAATCCTGTCCCAAATTCCATTTGGT

ATATTGGTACAAGGTGAAACCCAAGATACCAATCAAGCACTTGGAAAAGTAATTGTTAAAAAAACGGGAGAC

AATGCTACACCATTAGGCAAAGCGACTTTTGTGTTAAAAAATGACAATGATAAGTCAGAAACAAGTCACGAA

ACGGTAGAGGGTTCTGGAGAAGCAACCTTTGAAAACATAAAACCTGGAGACTACACATTAAGAGAAGAAACA

GCACCAATTGGTTATAAAAAAACTGATAAAACCTGGAAAGTTAAAGTTGCAGATAACGGAGCAACAATAATC

GAGGGTATGGATGCAGATAAAGCAGAGAAACGAAAAGAAGTTTTGAATGCCCAATATCCAAAATCAGCTATT

TATGAGGATACAAAAGAAAATTACCCATTAGTTAATGTAGAGGGTTCCAAAGTTGGTGAACAATACAAAGCA

TTGAATCCAATAAATGGAAAAGATGGTCGAAGAGAGATTGCTGAAGGTTGGTTATCAAAAAAAATTACAGGG

GTCAATGATCTCGATAAGAATAAATATAAAATTGAATTAACTGTTGAGGGTAAAACCACTGTTGAAACGAAA

GAACTTAATCAACCACTAGATGTCGTTGTGCTATTAGATAATTCAAATAGTATGAATAATGAAAGAGCCAAT

AATTCTCAAAGAGCATTAAAAGCTGGGGAAGCAGTTGAAAAGCTGATTGATAAAATTACATCAAATAAAGAC

AATAGAGTAGCTCTTGTGACATATGCCTCAACCATTTTTGATGGTACTGAAGCGACCGTATCAAAGGGAGTT

GCCGATCAAAATGGTAAAGCGCTGAATGATAGTGTATCATGGGATTATCATAAAACTACTTTTACAGCAACT

TABLE 11-continued

Amino acid and encoding DNA sequences of gbs1478 proteins derived from different strains of S. agalactiae ACACATAATTACAGTTATTTAAATTTAACAAATGATGCTAACGAAGTTAATATTCTAAAGTCAAGAATTCCA
AAGGAAGCGGAGCATATAAATGGGGATCGCACGCTCTATCAATTTGGTGCGACATTTACTCAAAAAGCTCTA
ATGAAAGCAAATGAAATTTTAGAGACACAAAGTTCTAATGCTAGAAAAAAACTTATTTTTCACGTAACTGAT
GGTGTCCCTACGATGTCTTATGCCATAAATTTTAATCCTTATATATCAACATCTTACCAAAACCAGTTTAAT
TCTTTTTTAAATAAAATACCAGATAGAAGTGGTATTCTCCAAGAGGATTTTATAATCAATGGTGATGATTAT
CAAATAGTAAAAGGAGATGGAGAGAGTTTTAAACTGTTTTCGGATAGAAAAGTTCCTGTTACTGGAGGAACG
ACACAAGCAGCTTATCGAGTACCGCAAAATCAACTCTCTGTAATGAGTAATGAGGGATATGCAATTAATAGT
GGATATATTTATCTCTATTGGAGAGATTACAACTGGGTCTATCCATTTGATCCTAAGACAAAGAAAGTTTCT
GCAACGAAACAAATCAAAACTCATGGTGAGCCAACAACATTATACTTTAATGGAAATATAAGACCTAAAGGT
TATGACATTTTTACTGTTGGGATTGGTGTAAACGGAGATCCTGGTGCAACTCCTCTTGAAGCTGAGAAATTT
ATGCAATCAATATCAAGTAAAACAGAAAATTATACTAATGTTGATGATACAAATAAAATTTATGATGAGCTA
AATAAATACTTTAAAACAATTGTTGAGGAAAAACATTCTATTGTTGATGGAAATGTGACTGATCCTATGGGA
GAGATGATTGAATTCCAATTAAAAAATGGTCAAAGTTTTACACATGATGATTACGTTTTGGTTGGAAATGAT
GGCAGTCAATTAAAAAATGGTGTGGCTCTTGGTGGACCAAACAGTGATGGGGAATTTTAAAAGATGTTACA
GTGACTTATGATAAGACATCTCAAACCATCAAAATCAATCATTTGAACTTAGGAAGTGGACAAAAAGTAGTT
CTTACCTATGATGTACGTTTAAAAGATAACTATATAAGTAACAAATTTTACAATACAAATAATCGTACAACG
CTAAGTCCGAAGAGTGAAAAAGAACCAAATACTATTCGTGATTTCCCAATTCCCAAAATTCGTGATGTTCGT
GAGTTTCCGGTACTAACCATCAGTAATCAGAAGAAAATGGGTGAGGTTGAATTTATTAAAGTTAATAAAGAC
AAACATTCAGAATCGCTTTTGGGAGCTAAGTTTCAACTTCAGATAGAAAAAGATTTTTCTGGGTATAAGCAA
TTTGTTCCAGAGGGAAGTGATGTTACAACAAAGAATGATGGTAAAATTTATTTTAAAGCACTTCAAGATGGT
AACTATAAATTATATGAAATTTCAAGTCCAGATGGCTATATAGAGGTTAAAACGAAACCTGTTGTGACATTT
ACAATTCAAATGGAGAAGTTACGAACCTGAAAGCAGATCCAAATGCTAATAAAAATCAAATCGGGTATCTT
GAAGGAAATGGTAAACATCTTATTACCAACACTCCCAAACGCCCACCAGGTGTTTTTCCTAAAACAGGGGGA
ATTGGTACAATTGTCTATATATTAGTTGGTTCTACTTTTATGATACTTACCATTTGTTCTTTCCGTCGTAAA
CAATTGTAA ORF amino acid sequence (SEQ ID NO: 194):

MKKRQKIWRGLSVTLLILSQIPFGILVQGETQDTNQALGKVIVKKTGDNATPLGKATFVLKNDNDKSETSHE
TVEGSGEATFENIKPGDYTLREETAPIGYKKTDKTWKVKVADNGATIIEGMDADKAEKRKEVLNAQYPKSAI
YEDTKENYPLVNVEGSKVGEQYKALNPINGKDGRREIAEGWLSKKITGVNDLDKNKYKIELTVEGKTTVETK
ELNQPLDVVVLLDNSNSMNNERANNSQRALKAGEAVEKLIDKITSNKDNRVALVTYASTIFDGTEATVSKGV
ADQNGKALNDSVSWDYHKTTFTATTHNYSYLNLTNDANEVNILKSRIPKEAEHINGDRTLYQFGATFTQKAL
MKANEILETQSSNARKKLIPHVTDGVPTMSYAINFNPYISTSYQNQFNSFLNKIPDRSGILQEDFIINGDDY
QIVKGDGESFKLFSDRKVPVTGGTTQAAYRVPQNQLSVMSNEGYAINSGYIYLYWRDYNWVYPFDPKTKKVS
ATKQIKTHGEPTTLYFNGNIRPKGYDIFTVGIGVNGDPGATPLEAEKFMQSISSKTENYTNVDDTNKIYDEL
NKYFKTIVEEKHSIVDGNVTDPMGEMIEFQLKNGQSFTHDDYVLVGNDSQLKNGVALGGPNSDGGILKDVT
VTYDKTSQTIKINHLNLGSGQKVVLTYDVRLKDNYISNKFYNTNNRTTLSPKSEKEPNTIRDFPIPKIRDVR
EFPVLTISNQKKMGEVEFIKVNKDKHSESLLGAKFQLQIEKDFSGYKQFVPEGSDVTTKNDGKIYFKALQDG

TABLE 11-continued

Amino acid and encoding DNA sequences of gbs1478 proteins derived from different strains of *S. agalactiae*

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL

Strain IC250
ORF DNA sequence (SEQ ID NO: 214):

ATGAGAAAATACCAAAAATTTTCTAAAATATTGACGTTAAGTCTTTTTTGTTTGTCGCAAATACCGCTTAAT
ACCAATGTTTTAGGGGAAAGTACCGTACCGGAAAATGGTGCTAAAGGAAAGTTAGTTGTTAAAAAGACAGAT
GACCAGAACAAACCACTTTCAAAAGCTACCTTTGTTTTAAAAACTACTGCTCAACCAGAAAGTAAAATAGAA
AAAGTAACTGCTGAGCTAACAGGTGAAGCTACTTTTGATAATCTCATACCTGGAGATTATACTTTATCAGAA
GAAACAGCGCCCGAAGGTTATAAAAAGACTAACCAGACTTGGCAAGTTAAGGTTGAGAGTAATGGAAAAACT
ACGATACAAAATAGTGGTGATAAAAATTCCACAATTGGACAAAATCAGGAAGAACTAGATAAGCAGTATCCC
CCCACAGGAATTTATGAAGATACAAAGGAATCTTATAAACTTGAGCATGTTAAAGGTTCAGTTCCAAATGGA
AAGTCAGAGGCAAAAGCAGTTAACCCATATTCAAGTGAAGGTGAGCATATAAGAGAAATTCCAGAGGGAACA
TTATCTAAACGTATTTCAGAAGTAGGTGATTTAGCTCATAATAAATATAAAATTGAGTTAACTGTCAGTGGA
AAAACCATAGTAAAACCAGTGGACAAACAAAAGCCGTTAGATGTTGTCTTCGTACTCGATAATTCTAACTCA
ATGAATAACGATGGCCCAAATTTTCAAAGGCATAATAAAGCCAAGAAAGCTGCCGAAGCTCTTGGGACCGCA
GTAAAAGATATTTTAGGAGCAAACAGTGATAATAGGGTTGCATTAGTTACCTATGGTTCAGATATTTTTGAT
GGTAGGAGTGTAGATGTCGTAAAAGGATTTAAAGAAGATGATAAATATTATGGCCTTCAAACTAAGTTCACA
ATTCAGACAGAGAATTATAGTCATAAACAATTAACAAATAATGCTGAAGAGATTATAAAAAGGATTCCGACA
GAAGCTCCTAAAGCTAAGTGGGGATCTACTACCAATGGATTAACTCCAGAGCAACAAAAGGAGTACTATCTT
AGTAAAGTAGGAGAAACATTTACTATGAAAGCCTTCATGGAGGCAGATGATATTTTGAGTCAAGTAAATCGA
AATAGTCAAAAAATTATTGTTCATGTAACTGATGGTGTTCCTACGAGATCATATGCTATTAATAATTTTAAA
CTGGGTGCATCATATGAAAGCCAATTTGAACAAATGAAAAAAAATGGATATCTAAATAAAAGTAATTTTCTA
CTTACTGATAAGCCCGAGGATATAAAAGGAAATGGGGAGAGTTACTTTTTGTTTCCCTTAGATAGTTATCAA
ACACAGATAATCTCTGGAAACTTACAAAAACTTCATTATTTAGATTTAAATCTTAATTACCCTAAAGGTACA
TTTTATCGAAATGGACCAGTAAGAGAACATGGAACACCAACCAAACTTTATATAAATAGTTTAAAACAGAAA
AATTATGACATCTTTAATTTTGGTATAGATATATCTGGTTTTAGACAAGTTTATAATGAGGATTATAAGAAA
AATCAAGATGGTACTTTTCAAAAATTGAAAGAGGAAGCTTTTGAACTTTCAGATGGGGAAATAACAGAACTA
ATGAAGTCATTCTCTTCTAAACCTGAGTATTATACCCCGATAGTAACTTCATCCGATGCATCTAACAATGAA
ATTTTATCTAAAATTCAGCAACAATTTGAAAAGATTTTAACAAAAGAAAACTCAATTGTTAATGGAACTATA
GAAGATCCTATGGGTGACAAAATCAATTTACAGCTTGGCAACGGACAAACATTGCAACCAAGTGATTATACT
TTACAGGGAAATGATGGAAGTATAATGAAAGATAGCATTGCAACTGGTGGGCCTAATAATGATGGTGGAATA
CTTAAAGGGGTTAAATTAGAATACATCAAAAATAAACTCTACGTTAGAGGTTTGAACTTAGGGGAGGGACAA
AAAGTAACACTCACATATGATGTGAAACTAGATGACAGTTTTATAAGTAACAAATTCTATGACACTAATGGT
AGAACAACATTGAATCCTAAATCAGAGGATCCTAATACACTTAGAGATTTTCCAATCCCTAAAATTCGTGAT
GTGAGAGAATATCCTACAATAACGATTAAAAACGAGAAGAAGTTAGGTGAAATTGAATTTACAAAAGTTGAT
AAAGATAATAATAAGTTGCTTCTCAAAGGAGCTACGTTTGAACTTCAAGAATTTAATGAAGATTATAAACTT
TATTTACCAATAAAAAATAATAATTCAAAAGTAGTGACGGGAGAAAACGGCAAAATTTCTTACAAAGATTTG
AAAGATGGCAAATATCAGTTAATAGAAGCAGTTTCGCCGAAGGATTATCAAAAAATTACTAATAAACCAATT
TTAACTTTTGAAGTTGTTAAAGGATCGATACAAAATATAATAGCTGTTAATAAACAGATTTCTGAATATCAT

TABLE 11-continued

Amino acid and encoding DNA sequences of gbs1478 proteins derived from different strains of S. agalactiae

GAGGAAGGTGACAAGCATTTAATTACCAACACGCATATTCCACCAAAAGGAATTATTCCGATGACAGGTGGG

AAAGGAATTCTATCTTTCATTTTAATAGGTGGATCTATGATGTCTATTGCAGGTGGAATTTATATTTGGAAA

AGATATAAGAAATCTAGTGATATATCTAGAGAAAAAGATTAA

ORF amino acid sequence (SEQ ID NO: 195):

MRKYQKFSKILTLSLFCLSQIPLNTNVLGESTVPENGAKGKLVVKKTDDQNKPLSKATFVLKTTAQPESKIE
KVTAELTGEATFDNLIPGDYTLSEETAPEGYKKTNQTWQVKVESNGKTTIQNSGDKNSTIGQNEELDKQYP
PTGIYEDTKESYKLEHVKGSVPNGKSEAKAVNPYSSEGEHIREIPEGTLSKRISEVGDLAHNKYKIELTVSG
KTIVKPVDKQKPLDVVFVLDNSNSMNNDGPNFQRHNKAKKAAEALGTAVKDILGANSDNRVALVTYGSDIFD
GRSVDVVKGFKEDDKYYGLQTKFTIQTENYSHKQLTNNAEEIIKRIPTEAPKAKWGSTTNGLTPEQQKEYYL
SKVGETFTMKAFMEADDILSQVNRNSQKIIVHVTDGVPTRSYAINNFKLGASYESQFEQMKKNGYLNKSNFL
LTDKPEDIKGNGESYFLFPLDSYQTQIISGNLQKLHYLDLNLNYPKGTFYRNGPVREHGTPTKLYINSLKQK
NYDIFNFGIDISGFRQVYNEDYKKNQDGTFQKLKEEAFELSDGEITELMKSFSSKPEYYTPIVTSSDASNNE
ILSKIQQQFEKILTKENSIVNGTIEDPMGDKINLQLGNGQTLQPSDYTLQGNDGSIMKDSIATGGPNNDGGI
LKGVKLEYIKNKLYVRGLNLGEGQKVTLTYDVKLDDSFISNKFYDTNGRTTLNPKSEDPNTLRDFPIPKIRD
VREYPTITIKNEKKLGEIEFTKVDKDNNKLLLKGATFELQEFNEDYKLYLPIKNNNSKVVTGENGKISYKDL
KDGKYQLIEAVSPKDYQKITNKPILTFEVVKGSIQNIIAVNKQISEYHEEGDKHLITNTHIPPKGIIPMTGG
KGILSFILIGGSMMSIAGGIYIWKRYKKSSDISREKD

Strain IC251
ORF DNA sequence (SEQ ID NO: 215):

ATGAAAAAGAGACAAAAAATATGGAGAGGGTTATCAGTTACTTTACTAATCCTGTCCCAAATTCCATTTGGT
ATATTGGTACAAGGTGAAACCCAAGATACCAATCAAGCACTTGGAAAAGTAATTGTTAAAAAAACGGGAGAC
AATGCTACACCATTAGGCAAAGCGACTTTTGTGTTAAAAAATGACAATGATAAGTCAGAAACAAGTCACGAA
ACGGTAGAGGGTTCTGGAGAAGCAACCTTTGAAAACATAAAACCTGGAGACTACACATTAAGAGAAGAAACA
GCACCAATTGGTTATAAAAAAACTGATAAAACCTGGAAAGTTAAAGTTGCAGATAACGGAGCAACAATAATC
GAGGGTATGGATGCAGATAAAGCAGAGAAACGAAAAGAAGTTTTGAATGCCCAATATCCAAAATCAGCTATT
TATGAGGATACAAAAGAAAATTACCCATTAGTTAATGTAGAGGGTTCCAAAGTTGGTGAACAATACAAAGCA
TTGAATCCAATAAATGGAAAAGATGGTCGAAGAGAGATTGCTGAAGGTTGGTTATCAAAAAAAATTACAGGG
GTCAATGATCTCGATAAGAATAAATATAAAATTGAATTAACTGTTGAGGGTAAAACCACTGTTGAAACGAAA
GAACTTAATCAACCACTAGATGTCGTTGTGCTATTAGATAATTCAAATAGTATGAATAATGAAAGAGCCAAT
AATTCTCAAAGAGCATTAAAAGCTGGGGAAGCAGTTGAAAAGCTGATTGATAAAATTACATCAAATAAAGAC
AATAGAGTAGCTCTTGTGACATATGCCTCAACCATTTTTGATGGTACTGAAGCGACCGTATCAAAGGGAGTT
GCCGATCAAAATGGTAAAGCGCTGAATGATAGTGTATCATGGGATTATCATAAAACTACTTTTACAGCAACT
ACACATAATTACAGTTATTTAAATTTAACAAATGATGCTAACGAAGTTAATATTCTAAAGTCAAGAATTCCA
AAGGAAGCGGAGCATATAAATGGGGATCGCACGCTCTATCAATTTGGTGCGACATTTACTCAAAAAGCTCTA
ATGAAAGCAAATGAAATTTAGAGACACAAAGTTCTAATGCTAGAAAAAACTTATTTTTCACGTAACTGAT
GGTGTCCCTACGATGTCTTATGCCATAAATTTTAATCCTTATATATCAACATCTTACCAAAACCAGTTTAAT
TCTTTTTTAAATAAAATACCAGATAGAAGTGGTATTCTCCAAGAGGATTTTATAATCAATGGTGATGATTAT
CAAATAGTAAAAGGAGATGGAGAGAGTTTTAAACTGTTTTCGGATAGAAAAGTTCCTGTTACTGGAGGAACG
ACACAAGCAGCTTATCGAGTACCGCAAAATCAACTCTCTGTAATGAGTAATGAGGGATATGCAATTAATAGT

TABLE 11-continued

Amino acid and encoding DNA sequences of gbs1478 proteins derived from different strains of *S. agalactiae*

GGATATATTTATCTCTATTGGAGAGATTACAACTGGGTCTATCCATTTGATCCTAAGACAAAGAAAGTTTCT

GCAACGAAACAAATCAAAACTCATGGTGAGCCAACAACATTATACTTTAATGGAAATATAAGACCTAAAGGT

TATGACATTTTTACTGTTGGGATTGGTGTAAACGGAGATCCTGGTGCAACTCCTCTTGAAGCTGAGAAATTT

ATGCAATCAATATCAAGTAAAACAGAAAATTATACTAATGTTGATGACAAATAAAATTTATGATGAGCTA

AATAAATACTTTAAAACAATTGTTGAGGAAAAACATTCTATTGTTGATGGAAATGTGACTGATCCTATGGGA

GAGATGATTGAATTCCAATTAAAAAATGGTCAAAGTTTTACACATGATGATTACGTTTTGGTTGGAAATGAT

GGCAGTCAATTAAAAAATGGTGTGGCTCTTGGTGGACCAAACAGTGATGGGGAATTTTAAAAGATGTTACA

GTGACTTATGATAAGACATCTCAAACCATCAAAATCAATCATTTGAACTTAGGAAGTGGACAAAAAGTAGTT

CTTACCTATGATGTACGTTTAAAAGATAACTATATAAGTAACAAATTTTACAATACAATAATCGTACAACG

CTAAGTCCGAAGAGTGAAAAAGAACCAAATACTATTCGTGATTTCCCAATTCCCAAAATTCGTGATGTTCGT

GAGTTTCCGGTACTAACCATCAGTAATCAGAAGAAAATGGGTGAGGTTGAATTTATTAAAGTTAATAAAGAC

AAACATTCAGAATCGCTTTTGGGAGCTAAGTTTCAACTTCAGATAGAAAAGATTTTTCTGGGTATAAGCAA

TTTGTTCCAGAGGGAAGTGATGTTACAACAAAGAATGATGGTAAAATTTATTTTAAAGCACTTCAAGATGGT

AACTATAAATTATATGAAATTTCAAGTCCAGATGGCTATATAGAGGTTAAAACGAAACCTGTTGTGACATTT

ACAATTCAAAATGGAGAAGTTACGAACCTGAAAGCAGATCCAAATGCTAATAAAAATCAAATCGGGTATCTT

GAAGGAAATGGTAAACATCTTATTACCAACACTCCCAAACGCCCACCAGGTGTTTTTCCTAAAACAGGGGGA

ATTGGTACAATTGTCTATATATTAGTTGGTTCTACTTTTATGATACTTACCATTTGTTCTTTCCGTCGTAAA

CAATTGTAA

ORF amino acid sequence (SEQ ID NO: 196):

MKKRQKIWRGLSVTLLILSQIPFGILVQGETQDTNQALGKVIVKKTGDNATPLGKATFVLKNDNDKSETSHE

TVEGSGEATFENIKPGDYTLREETAPIGYKKTDKTWKVKVADNGATIIEGMDADKAEKRKEVLNAQYPKSAI

YEDTKENYPLVNVEGSKVGEQYKALNPINGKDGRREIAEGWLSKKITGVNDLDKNKYKIELTVEGKTTVETK

ELNQPLDVVVLLDNSNSMNNERANNSQRALKAGEAVEKLIDKITSNKDNRVALVTYASTIFDGTEATVSKGV

ADQNGKALNDSVSWDYHKTTFTATTHNYSYLNLTNDANEVNILKSRIPKEAEHINGDRTLYQFGATFTQKAL

MKANEILETQSSNARKKLIFHVTDGVPTMSYAINFNPYISTSYQNQFNSFLNKIPDRSGILQEDFIINGDDY

QIVKGDGESFKLFSDRKVPVTGGTTQAAYRVPQNQLSVMSNEGYAINSGYIYLYWRDYNWVYPFDPKTKKVS

ATKQIKTHGEPTTLYFNGNIRPKGYDIFTVGIGVNGDPGATPLEAEKFMQSISSKTENYTNVDDTNKIYDEL

NKYFKTIVEEKHSIVDGNVTDPMGEMIEFQLKNGQSFTHDDYVLVGNDGSQLKNGVALGGPNSDGGILKDVT

VTYDKTSQTIKINHLNLGSGQKVVLTYDVRLKDNYISNKFYNTNNRTTLSPKSEKEPNTIRDFPIPKIRDVR

EFPVLTISNQKKMGEVEFIKVNKDKHSESLLGAKFQLQIEKDFSGYKQFVPEGSDVTTKNDGKIYFKALQDG

NYKLYEISSPDGYIEVKTKPVVTFTIQNGEVTNLKADPNANKNQIGYLEGNGKHLITNTPKRPPGVFPKTGG

IGTIVYILVGSTFMILTICSFRRKQL

Strain IC253
ORF DNA sequence (SEQ ID NO: 216):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAAACTACTGCTCATCCAGAAAGTAAAATAGAA

AAAGTAACTGCTGAGCTAACAGGTGAAGCTACTTTTGATAATCTCATACCTGGAGATTATACTTTATCAGAA

GAAACAGCGCCCGAAGGTTATAAAAAGACTAACCAGACTTGGCAAGTTAAGGTTGAGAGTAATGGAAAAACT

TABLE 11-continued

Amino acid and encoding DNA sequences of gbs1478 proteins derived from different strains of *S. agalactiae*

ACGATACAAAATAGTGGTGATAAAAATTCCACAATTGGACAAAATCACGAAGAACTAGATAAGCAGTATCCC
CCCACAGGAATTTATGAAGATACAAAGGAATCTTATAAACTTGAGCATGTTAAAGGTTCAGTTCCAAATGGA
AAGTCAGAGGCAAAAGCAGTTAACCCATATTCAAGTGAAGGTGAGCATATAAGAGAAATTCCAGAGGGAACA
TTATCTAAACGTATTTCAGAAGTAGGTGATTTAGCTCATAATAAATATAAAATTGAGTTAACTGTCAGTGGA
AAAACCATAGTAAAACCAGTGGACAAACAAAAGCCGTTAGATGTTGTCTTCGTACTCGATAATTCTAACTCA
ATGAATAACGATGGCCCAAATTTTCAAAGGCATAATAAAGCCAAGAAAGCTGCCGAAGCTCTTGGGACCGCA
GTAAAAGATATTTTAGGAGCAAACAGTGATAATAGGGTTGCATTAGTTACCTATGGTTCAGATATTTTTGAT
GGTAGGAGTGTAGATGTCGTAAAAGGATTTAAAGAAGATGATAAATATTATGGCCTTCAAACTAAGTTCACA
ATTCAGACAGAGAATTATAGTCATAAACAATTAACAAATAATGCTGAAGAGATTATAAAAAGGATTCCTACA
GAAGCTCCTAGAGCTAAATGGGGATCAACTACAAACGGACTTACTCCAGAGCAACAAAAGCAGTACTATCTT
AGTAAAGTAGGGGAAACATTTACTATGAAAGCCTTCATGGAGGCAGATGATATTTTGAGTCAAGTAGATCGA
AATAGTCAAAAAATTATTGTTCATATAACTGATGGTGTTCCAACAAGATCATATGCTATTAATAATTTTAAA
TTGGGTGCATCATATGAAAGCCAATTTGAACAAATGAAAAAAAATGGATATCTAAATAAAAGTAATTTTCTA
CTTACTGATAAGCCCGAGGATATAAAAGGAAATGGGGAGAGTTACTTTTTGTTTCCCTTAGATAGTTATCAA
ACACAGATAATCTCTGGAAACTTACAAAAACTTCATTATTTAGATTTAAATCTTAATTACCCTAAAGGTACA
ATTTATCGAAATGGACCAGTAAGAGAACATGGAACACCAACCAAACTTTATATAAATAGTTTAAAACAGAAA
AATTATGACATCTTTAATTTTGGTATAGATATATCTGCTTTTAGACAAGTTTATAATGAGGATTATAAGAAA
AATCAAGATGGTACTTTTCAAAAATTGAAAGAGGAAGCTTTTGAACTTTCAGATGGGGAAATAACAGAACTA
ATGAAGTCATTCTCTTCTAAACCTGAGTATTATACCCCGATAGTAACTTCATCCGATGCATCTAACAATGAA
ATTTTATCTAAAATTCAGCAACAATTTGAAAAGGTTTTAACAAAAGAAAACTCAATTGTTAATGGAACTATA
GAAGATCCTATGGGTGACAAAATCAATTTACAGCTTGGCAACGGACAAACATTGCAACCAAGTGATTATACT
TTACAGGGAAATGATGAAGTATAATGAAAGATAGCATTGCAACTGGTGGGCCTAATAATGATGGTGGAATA
CTTAAAGGGGTTAAATTAGAATACATCAAAAATAAACTCTACGTTAGAGGTTTGAACTTAGGGGAGGGACAA
AAAGTAACACTCACATATGATGTGAAACTAGATGACAGTTTTATAAGTAACAAATTCTATGACACTAATGGT
AGAACAACATTGAATCCTAAATCAGAGGATCCTAATACACTTAGAGATTTTCCAATCCCTAAAATTCGTGAT
GTGAGAGAATATCCTACAATAACGATTAAAAACGAGAAGAAGTTAGGTGAAATTGAATTTACAAAAGTTGAT
AAAGATAATAATAAGTTGCTTCTCAAAGGAGCTACGTTTGAACTTCAAGAATTTAATGAAGATTATAAACTT
TATTTACCAATAAAAAATAATAATTCAAAGTAGTGACGGGAGAAAACGGCAAAATTTCTTACAAAGATTTG
AAAGATGGCAAATATCAGTTAATAGAAGCAGTTTCGCCGAAGGATTATCAAAAAATTACTAATAAACCAATT
TTAACTTTTGAAGTTGTTAAAGGATCGATACAAAATATAATAGCTGTTAATAAACAGATTTCTGAATATCAT
GAGGAAGGTGACAAGCATTTAATTACCAACACGCATATTCCACCAAAAGGAATTATTCCGATGACAGGTGGG
AAAGGAATTCTATCTTTCATTTTAATAGGTGGATCTATGATGTCTATTGCAGGTGGAATTTATATTTGGAAA
AGATATAAGAAATCTAGTGATATATCTAGAGAAAAAGATTAA

ORF amino acid sequence (SEQ ID NO: 197):

MRKYQKFSKILTLSLFCLSQIPLNTNVLGESTVPENGAKGKLVVKKTDDQNKPLSKATFVLKTTAHPESKIE
KVTAELTGEATFDNLIPGDYTLSEETAPEGYKKTNQTWQVKVESNGKTTIQNSGDKNSTIGQNHEELDKQYP
PTGIYEDTKESYKLEHVKGSVPNGKSEAKAVNPYSSEGEHIREIPEGTLSKRISEVGDLAHNKYKIELTVSG
KTIVKPVDKQKPLDVVFVLDNSNSMNNDGPNFQRHNKAKKAAEEALGTAVKDILGANSDNRVALVTYGSDIFD

TABLE 11-continued

Amino acid and encoding DNA sequences of gbs1478 proteins derived from different strains of *S. agalactiae*

GRSVDVVKGFKEDDKYYGLQTKFTIQTENYSHKQLTNNAEEIIKRIPTEAPRAKWGSTTNGLTPEQQKQYYL

SKVGETFTMKAFMEADDILSQVDRNSQKIIVHITDGVPTRSYAINNFKLGASYESQFEQMKKNGYLNKSNFL

LTDKPEDIKGNGESYFLFPLDSYQTQIISGNLQKLHYLDLNLNYPKGTIYRNGPVREHGTPTKLYINSLKQK

NYDIFNFGIDISAFRQVYNEDYKKNQDGTFQKLKEEAFELSDGEITELMKSFSSKPEYYTPIVTSSDASNNE

ILSKIQQOFEKVLTKENSIVNGTIEDPMGDKINLQLGNGQTLQPSDYTLQGNDGSIMKDSIATGGPNNDGGI

LKGVKLEYIKNKLYVRGLNLGEGQKVTLTYDVKLDDSFISNKFYDTNGRTTLNPKSEDPNTLRDFPIPKIRD

VREYPTITIKNEKKLGEIEFTKVDKDNNKLLLKGATFELQEFNEDYKLYLPIKNNNSKVVTGENGKISYKDL

KDGKYQLIEAVSPKDYQKITNKPILTFEVVKGSIQNIIAVNKQISEYHEEGDKHLITNTHIPPKGIIPMTGG

KGILSFILIGGSMMSIAGGIYIWKRYKKSSDISREKD

Strain IC289
ORF DNA sequence (SEQ ID NO: 217):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAACCTACTTCACACTCAGAAAGCAAAGTAGAA

AAAGTAACTACTGAGGTAACAGGTGAAGCTACTTTTGATAATCTCACACCTGGAGATTACACTTTATCAGAA

GAAACGGCACCCGAAGGATACAAAAAGACTACCCAGACTTGGCAAGTTAAGGTTGAGAGTAATGGAAAAACT

ACGATACAAAATAGTGATGATAAAAAATCTATAATTGAACAAAGGCAAGAGGAACTAGATAAGCAGTATCCC

CTTACAGGAGCTTATGAAGATACAAAAGAATCTTATAATCTTGAGCATGTTAAAAATTCAATTCCAAATGGG

AAATTAGAGGCAAAAGCAGTTAATCCATATTCAAGTGAAGGTGAGCACATAAGAGAAATTCAAGAGGGAACA

TTATCTAAACGTATTTCAGAAGTAAATGATTTGGATCATAATAAATATAAAATTGAGTTAACTGTTAGCGGT

AAATCCATAATAAAAACTATAAATAAAGATGAACCTCTGGATGTTGTTTTTGTTCTTGATAATTCAAATTCT

ATGAAGAATAATGGAAAAAATAACAAGGCAAAAAGGCAGGTGAAGCAGTAGAAACAATTATAAAAGATGTT

TTAGGAGCAAATGTTGAAAACCGAGCAGCTTTAGTTACTTATGGTTCAGATATTTTTGATGGAAGGACAGTT

AAAGTTATAAAAGGTTTTAAAGAGGATCCTTATTATGGACTTGAAACTAGTTTCACAGTTCAGACAAATGAT

TATAGCTATAAAAAGTTCACTAATATTGCTGCTGATATTATAAAAAAGATCCCTAAAGAAGCTCCAGAAGCT

AAGTGGGGGGGGACAAGTCTAGGATTAACTCCAGAAAAAAAGAGGGAATATGATTTAAGTAAAGTAGGTGAG

ACCTTTACAATGAAAGCTTTTATGGAGGCAGATACCTTGTTAAGTAGTATACAGCGTAAGAGTAGAAAGATT

ATTGTTCATCTAACTGACGGTGTTCCAACAAGATCATATGCCATTAATAGTTTTGTAAAAGGTTCAACATAC

GCAAATCAATTTGAGAGAATAAAAGAAAAAGGTTATTTAGACAAAAATAATTATTTTATAACTGATGATCCA

GAAAAGATCAAAGGCAATGGGAGAGTTACTTTTTGTTTCCCTTAGATAGTTATCAAACACAGATAATTTCT

GGAAACTTACAAAAACTTCATTATTTAGATTTAAATCTTAATTACCCTAAAGGTACAATTTATAGAAATGGA

CCAGTAAGAGAACATGGAACACCAACCAAACTTTATATAAATAGTTTAAAACAGAAAAATTATGACATCTTT

AATTTTGGTATAGATATATCTGGTTTTAGACAAGTTTATAATGAGGATTATAAGAAAAATCAAGATGGTACT

TTTCAAAAATTGAAGGAGGAAGCTTTTGAACTTTCAGATGGGGAAATAACAGAACTAATGAATTCATTCTCT

TCTAAACCTGAGTATTATACCCCGATAGTAACTTCAGCTGATGTATCTAATAATGAAATTTTATCTAAAATT

CAGCAACAATTTGAAAAGATTTTAACAAAGGAAAACTCAATTGTTAATGGAACTATAGAAGATCCTATGGGT

GATAAAATCAATTTACATCTTGGCAACGGACAAACATTGCAACCAAGTGATTATACTTTACAGGGAAATGAT

GGAAGTATAATGAAAGATAGCATTGCAACTGGAGGGCCTAATAATGATGGTGGGATACTTAAAGGGGTTAAA

TTAGAATACATCAAAAATAAACTCTACGTTAGAGGTTTGAACTTAGGGGAGGGGCAAAAAGTAACACTCACA

TABLE 11-continued

Amino acid and encoding DNA sequences of gbs1478 proteins derived from different strains of S. agalactiae

TATGATGTGAAACTAGATGACAGTTTTATTAGTAACAAATTCTATGACACTAATGGTAGAACAACATTGAAT

CCTAAATCAGAGGAACCCGATACACTTAGAGATTTTCCAATCCCTAAAATTCGTGATGTGAGAGAATATCCT

ACAATAACGATTAAAAACGAGAAGAAGTTAGGTGAAATTGAATTTACAAAAGTTGATAAAGATAATAATAAG

TTGCTTCTCAAAGGAGCTACATTTGAACTTCAAGAATTTAATGAAGATTATAAACTTTATTTACCAATAAAA

AATAATAATTCAAAAGTAGTGACGGGAGAAAACGGCAAAATTTCTTACAAAGATTTGAAAGATGGCAAATAT

CAGTTAATAGAAGCAGTTTCGCCGAAGGATTATCAAAAAATTACTAATAAACCAATTTTAACTTTTGAAGTT

GTTAAAGGATCGATACAAAATATAATAGCTGTTAATAAACAGATTTCTGAATATCATGAGGAAGGTGACAAG

CATTTAATTACCAACACGCATATTCCACCAAAAGGAATTATTCCGATGACAGGTGGGAAAGGAATTCTATCT

TTCATTTTAATAGGTGGAGCTATGATGTCTATTGCAGGTGGAATTTATATTTGGAAAAGACATAAGAAATCT

AGTGATGCATCAATCGAGAAAGATTAA

ORF amino acid sequence (SEQ ID NO: 198):

MRKYQKFSKILTLSLFCLSQIPLNTNVLGESTVPENGAKGKLVVKKTDDQNKPLSKATFVLKPTSHSESKVE

KVTTEVTGEATFDNLTPGDYTLSEETAPEGYKKTTQTWQVKVESNGKTTIQNSDDKKSIIEQRQEELDKQYP

LTGAYEDTKESYNLEHVKNSIPNGKLEAKAVNPYSSEGEHIREIQEGTLSKRISEVNDLDHNKYKIELTVSG

KSIIKTINKDEPLDVVFVLDNSNSMKNNGKNNKAKKAGEAVETIIKDVLGANVENRAALVTYGSDIFDGRTV

KVIKGFKEDPYYGLETSFTVQTNDYSYKKFTNIAADIIKKIPKEAPEAKWGGTSLGLTPEKKREYDLSKVGE

TFTMKAFMEADTLLSSIQRKSRKIIVHLTDGVPTRSYAINSFVKGSTYANQFERIKBKGYLDKNNYFITDDP

EKIKGNGESYFLFPLDSYQTQIISGNLQKLHYLDLNLNYPKGTIYRNGPVREHGTPTKLYINSLKQKNYDIF

NFGIDISGFRQVYNEDYKKNQDGTFQKLKEEAFELSDGEITELMNSFSSKPEYYTPIVTSADVSNNEILSKI

QQQFEKILTKENSIVNGTIEDPMGDKINLHLGNGQTLQPSDYTLQGNDGSIMKDSIATGGPNNDGGILKGVK

LEYIKNKLYVRGLNLGEGQKVTLTYDVKLDDSFISNKFYDTNGRTTLNPKSEEPDTLRDFPIPKIRDVREYP

TITIKNEKKLGEIEFTKVDKDNNKLLLKGATFELQEFNEDYKLYLPIKNNNSKVVTGENGKISYKDLKDGKY

QLIEAVSPKDYQKITNKPILTFEVVKGSIQNIIAVNKQISEYHEEGDKHLITNTHIPPKGIIPMTGGKGILS

FILIGGAMMSIAGGIYIWKRHKKSSDASIEKD

Strain IC291
ORF DNA sequence (SEQ ID NO: 218):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAAACTACTGCTCATCCAGAAAGTAAAATAGAA

AAAGTAACTGCTGAGCTAACAGGTGAAGCTACTTTTGATAATCTCATACCTGGAGATTATACTTTATCAGAA

GAAACAGCGCCCGAAGGTTATAAAAAGACTAACCAGACTTGGCAAGTTAAGGTTGAGAGTAATGGAAAAACT

ACGATACAAAATAGTGGTGATAAAAAATTCCACAATTGGACAAAATCAGGAAGAACTAGATAAGCAGTATCCC

CCCACAGGAATTTATGAAGATACAAAGGAATCTTATAAACTTGAGCATGTTAAAGGTTCAGTTCCAAATGGA

AAGTCAGAGGCAAAAGCAGTTAACCCATATTCAAGTGAAGGTGAGCATATAAGAGAAATTCCAGAGGGAACA

TTATCTAAACGTATTTCAGAAGTAGGTGATTTAGCTCATAATAAATATAAAATTGAGTTAACTGTCAGTGGA

AAAACCATAGTAAAACCAGTGGACAAACAAAAGCCGTTAGATGTTGTCTTCGTACTCGATAATTCTAACTCA

ATGAATAACGATGGCCCAAATTTTCAAAGGCATAATAAAGCCAAGAAAGCTGCCGAAGCTCTTGGGACCGCA

GTAAAAGATATTTTAGGAGCAAACAGTGATAATAGGGTTGCATTAGTTACCTATGGTTCAGATATTTTTGAT

GGTAGGAGTGTAGATGTCGTAAAAGGATTTAAAGAAGATGATAAATATTATGGCCTTCAAACTAAGTTCACA

TABLE 11-continued

Amino acid and encoding DNA sequences of gbs1478 proteins derived from different strains of S. agalactiae ATTCAGACAGAGAATTATAGTCATAAACAATTAACAAATAATGCTGAAGAGATTATAAAAGGATTCCGACA
GAAGCTCCTAAAGCTAAGTGGGGATCTACTACCAATGGATTAACTCCAGAGCAACAAAAGGAGTACTATCTT
AGTAAAGTAGGAGAAACATTTACTATGAAAGCCTTCATGGAGGCAGATGATATTTTGAGTCAAGTAAATCGA
AATAGTCAAAAAATTATTGTTCATGTAACTGATGGTGTTCCTACGAGATCATATGCTATTAATAATTTTAAA
CTGGGTGCATCATATGAAAGCCAATTTGAACAAATGAAAAAAATGGATATCTAAATAAAAGTAATTTTCTA
CTTACTGATAAGCCCGAGGATATAAAAGGAAATGGGGAGAGTTACTTTTTGTTTCCCTTAGATAGTTATCAA
ACACAGATAATCTCTGGAAACTTACAAAAACTTCATTATTTAGATTTAAATCTTAATTACCCTAAAGGTACA
TTTTATCGAAATGGACCAGTAAGAGAACATGGAACACCAACCAAACTTTATATAAATAGTTTAAAACAGAAA
AATTATGACATCTTTAATTTTGGTATAGATATATCTGGTTTTAGACAAGTTTATAATGAGGATTATAAGAAA
AATCAAGATGGTACTTTTCAAAAATTGAAAGAGGAAGCTTTTGAACTTTCAGATGGGGAAATAACAGAACTA
ATGAAGTCATTCTCTTCTAAACCTGAGTATTATACCCCGATAGTAACTTCATCCGATGCATCTAACAATGAA
ATTTTATCTAAAATTCAGCAACAATTTGAAAAGATTTTAACAAAAGAAAACTCAATTGTTAATGGAACTATA
GAAGATCCTATGGGTGACAAAATCAATTTACAGCTTGGCAACGGACAAACATTGCAACCAAGTGATTATACT
TTACAGGGAAATGATGGAAGTATAATGAAAGATAGCATTGCAACTGGTGGGCCTAATAATGATGGTGGAATA
CTTAAAGGGGTTAAATTAGAATACATCAAAAATAAACTCTACGTTAGAGGTTTGAACTTAGGGGAGGGACAA
AAAGTAACACTCACATATGATGTGAAACTAGATGACAGTTTTATAAGTAACAAATTCTATGACACTAATGGT
AGAACAACATTGAATCCTAAATCAGAGGATCCTAATACACTTAGAGATTTTCCAATCCCTAAAATTCGTGAT
GTGAGAGAATATCCTACAATAACGATTAAAAACGAGAAGAAGTTAGGTGAAATTGAATTTACAAAAGTTGAT
AAAGATAATAATAAGTTGCTTCTCAAAGGAGCTACGTTTGAACTTCAAGAATTTAATGAAGATTATAAACTT
TATTTACCAATAAAAAATAATAATTCAAAAGTAGTGACGGGAGAAAACGGCAAAATTTCTTACAAAGATTTG
AAAGATGGCAAATATCAGTTAATAGAAGCAGTTTCGCCGAAGGATTATCAAAAAATTACTAATAAACCAATT
TTAACTTTTGAAGTTGTTAAAGGATCGATACAAAATATAATAGCTGTTAATAAACAGATTTCTGAATATCAT
GAGGAAGGTGACAAGCATTTAATTACCAACACGCATATTCCACCAAAAGGAATTATTCCGATGACAGGTGGG
AAAGGAATTCTATCTTTCATTTTAATAGGTGGATCTATGATGTCTATTGCAGGTGGAATTTATATTTGGAAA
AGATATAAGAAATCTAGTGATATATCTAGAGAAAAAGATTAA ORF amino acid sequence (SEQ ID NO: 199):

MRKYQKFSKILTLSLFCLSQIPLNTNVLGESTVPENGAKGKLVVKKTDDQNKPLSKATFVLKTTAHPESKIE
KVTAELTGEATFDNLIPGDYTLSEETAPEGYKKTNQTWQVKVESNGKTTIQNSGDKNSTIGQNQEBLDKQYP
PTGIYEDTKESYKLEHVKGSVPNGKSEAKAVNPYSSEGEHIREIPEGTLSKRISEVGDLAHNKYKIELTVSG
KTIVKPVDKQKPLDVVFVLDNSNSMNNDGPNFQRHNKAKKAAEALGTAVKDILGANSDNRVALVTYGSDIFD
GRSVDVVKGFKEDDKYYGLQTKFTIQTENYSHKQLTNNAEEIIKRIPTEAPKAKWGSTTNGLTPEQQKEYYL
SKVGETFTMKAFMEADDILSQVNRNSQKIIVHVTDGVPTRSYAINNFKLGASYESQFEQMKKNGYLNKSNFL
LTDKPEDIKGNGESYFLFPLDSYQTQIISGNLQKLHYLDLNLNYPKGTFYRNGPVREHGTPTKLYINSLKQK
NYDIFNFGIDISGFRQVYNEDYKKNQDGTFQKLKEEAFELSDGEITELMKSFSSKPEYYTPIVTSSDASNNE
ILSKIQQQFEKILTKENSIVNGTIEDPMGDKINLQLGNGQTLQPSDYTLQGNDSIMKDSIATGGPNNDGGI
LKGVKLEYIKNKLYVRGLNLGEGQKVTLTYDVKLDDSFISNKFYDTNGRTTLNPKSEDPNTLRDFPIPKIRD
VREYPTITIKNEKKLGEIEFTKVDKDNNKLLLKGATFELQEFNEDYKLYLPIKNNNSKVVTGENGKISYKDL

TABLE 11-continued

Amino acid and encoding DNA sequences of gbs1478 proteins derived from different strains of *S. agalactiae*

KDGKYQLIEAVSPKDYQKITNKPILTFEVVKGSIQNIIAVNKQISEYHEEGDKHLITNTHIPPKGIIPMTGG

KGILSFILIGGSMMSIAGGIYIWKRYKKSSDISREKD

Strain IC304
ORF DNA sequence (SEQ ID NO: 219):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAAACTACTGCTCAACCAGAAAGTAAAATAGAA

AAAGTAACTGCTGAGCTAACAGGTGAAGCTACTTTTGATAATCTCATACCTGGAGATTATACTTTATCAGAA

GAAACAGCGCCCGAAGGTTATAAAAAGACTAACCAGACTTGGCAAGTTAAGGTTGAGAGTAATGGAAAAACT

ACGATACAAAATAGTGGTGATAAAAATTCCACAATTGGACAAAATCAGGAAGAACTAGATAAGCAGTATCCC

CCCACAGGAATTTATGAAGATACAAAGGAATCTTATAAACTTGAGCATGTTAAAGGTTCAGTTCCAAATGGA

AAGTCAGAGGCAAAAGCAGTTAACCCATATTCAAGTGAAGGTGAGCATATAAGAGAAATTCCAGAGGGAACA

TTATCTAAACGTATTTCAGAAGTAGGTGATTTAGCTCATAATAAATATAAAATTGAGTTAACTGTCAGTGGA

AAAACCATAGTAAAACCAGTGGACAAACAAAAGCCGTTAGATGTTGTCTTCGTACTCGATAATTCTAACTCA

ATGAATAACGATGGCCCAAATTTTCAAAGGCATAATAAAGCCAAGAAAGCTGCCGAAGCTCTTGGGACCGCA

GTAAAAGATATTTTAGGAGCAAACAGTGATAATAGGGTTGCATTAGTTACCTATGGTTCAGATATTTTTGAT

GGTAGGAGTGTAGATGTCGTAAAAGGATTTAAAGAAGATGATAAATATTATGGCCTTCAAACTAAGTTCACA

ATTCAGACAGAGAATTATAGTCATAAACAATTAACAAATAATGCTGAAGAGATTATAAAAAGGATTCCGACA

GAAGCTCCTAAAGCTAAGTGGGGATCTACTACCAATGGATTAACTCCAGAGCAACAAAAGGAGTACTATCTT

AGTAAAGTAGGAGAAACATTTACTATGAAAGCCTTCATGGAGGCAGATGATATTTTGAGTCAAGTAAATCGA

AATAGTCAAAAAATTATTGTTCATGTAACTGATGGTGTTCCTACGAGATCATATGCTATTAATAATTTTAAA

CTGGGTGCATCATATGAAAGCCAATTTGAACAAATGAAAAAAATGGATATCTAAATAAAAGTAATTTTCTA

CTTACTGATAAGCCCGAGGATATAAAAGGAAATGGGGAGAGTTACTTTTTGTTTCCCTTAGATAGTTATCAA

ACACAGATAATCTCTGGAAACTTACAAAAACTTCATTATTTAGATTTAAATCTTAATTACCCTAAAGGTACA

TTTTATCGAAATGGACCAGTAAGAGAACATGGAACACCAACCAAACTTTATATAAATAGTTTAAAACAGAAA

AATTATGACATCTTTAATTTTGGTATAGATATATCTGGTTTTAGACAAGTTTATAATGAGGATTATAAGAAA

AATCAAGATGGTACTTTTCAAAAATTGAAAGAGGAAGCTTTTGAACTTTCAGATGGGGAAATAACAGAACTA

ATGAAGTCATTCTCTTCTAAACCTGAGTATTATACCCCGATAGTAACTTCATCCGATGCATCTAACAATGAA

ATTTTATCTAAAATTCAGCAACAATTTGAAAAGATTTTAACAAAAGAAAACTCAATTGTTAATGGAACTATA

GAAGATCCTATGGGTGACAAAATCAATTTACAGCTTGGCAACGGACAAACATTGCAACCAAGTGATTATACT

TTACAGGGAAATGATGGAAGTATAATGAAAGATAGCATTGCAACTGGTGGGCCTAATAATGATGGTGGAATA

CTTAAAGGGGTTAAATTAGAATACATCAAAAATAAACTCTACGTTAGAGGTTTGAACTTAGGGGAGGGACAA

AAAGTAACACTCACATATGATGTGAAACTAGATGACAGTTTTATAAGTAACAAATTCTATGACACTAATGGT

AGAACAACATTGAATCCTAAATCAGAGGATCCTAATACACTTAGAGATTTTCCAATCCCTAAAATTCGTGAT

GTGAGAGAATATCCTACAATAACGATTAAAAACGAGAAGAAGTTAGGTGAAATTGAATTTACAAAAGTTGAT

AAAGATAATAATAAGTTGCTTCTCAAAGGAGCTACGTTTGAACTTCAAGAATTTAATGAAGATTATAAACTT

TATTTACCAATAAAAAATAATAATTCAAAAGTAGTGACGGGAGAAAACGGCAAAATTTCTTACAAAGATTTG

AAAGATGGCAAATATCAGTTAATAGAAGCAGTTTCGCCGAAGGATTATCAAAAAATTACTAATAAACCAATT

TTAACTTTTGAAGTTGTTAAAGGATCGATACAAAATATAATAGCTGTTAATAAACAGATTTCTGAATATCAT

TABLE 11-continued

Amino acid and encoding DNA sequences of gbs1478 proteins derived from different strains of *S. agalactiae*

GAGGAAGGTGACAAGCATTTAATTACCAACACGCATATTCCACCAAAAGGAATTATTCCGATGACAGGTGGG

AAAGGAATTCTATCTTTCATTTTAATAGGTGGATCTATGATGTCTATTGCAGGTGGAATTTATATTTGGAAA

AGATATAAGAAATCTAGTGATATATCTAGAGAAAAAGATTAA

ORF amino acid sequence (SEQ ID NO: 200):

MRKYQKFSKILTLSLFCLSQIPLNTNVLGESTVPENGAKGKLVVKKTDDQNKPLSKATFVLKTTAQPESKIE

KVTAELTGEATFDNLIPGDYTLSEETAPEGYKKTNQTWQVKVESNGKTTIQNSGDKNSTIGQNQEELDKQYP

PTGIYEDTKESYKLEHVKGSVPNGKSEAKAVNPYSSEGEHIREIPEGTLSKRISEVGDLAHNKYKIELTVSG

KTIVKPVDKQKPLDVVFVLDNSNSMNNDGPNFQRHNKAKKAAEALGTAVKDILGANSDNRVALVTYGSDIFD

GRSVDVVKGFKEDDKYYGLQTKFTIQTENYSHKQLTNNAEEIIKRIPTEAPKAKWGSTTNGLTPEQQKEYYL

SKVGETFTMKAFMEADDILSQVNRNSQKIIVHVTDGVPTRSYAINNFKLGASYESQFEQMKKNGYLNKSNFL

LTDKPEDIKGNGESYFLFPLDSYQTQIISGNLQKLHYLDLNLNYPKGTFYRNGPVREHGTPTKLYINSLKQK

NYDIFNFGIDISGFRQVYNEDYKKNQDGTFQKLKEEAFELSDGEITELMKSFSSKPEYYTPIVTSSDASNNE

ILSKIQQQFEKILTKENSIVNGTIEDPMGDKINLQLGNGQTLQPSDYTLQGNDGSIMKDSIATGGPNNDGGI

LKGVKLEYIKNKLYVRGLNLGEGQKVTLTYDVKLDDSFISNKFYDTNGRTTLNPKSEDPNTLRDFPIPKIRD

VREYPTITIKNEKKLGEIEFTKVDKDNNKLLLKGATFELQEFNEDYKLYLPIKNNNSKVVTGENGKISYKDL

KDGKYQLIEAVSPKDYQKITNKPILTFEVVKGSIQNIIAVNKQISEYHEEGDKHLITNTHIPPKGIIPMTGG

KGILSFILIGGSMMSIAGGIYIWKRYKKSSDISREKD

Strain IC305
ORF DNA sequence (SEQ ID NO: 220):

ATGAGAAAATACCAAAATTTTCTAAAATATTGACGTTAAGTCTTTTTTGTTTGTCGCAAATACCGCTTAAT

ACCAATGTTTTAGGGGAAAGTACCGTACCGGAAATGGTGCTAAAGGAAAGTTAGTTGTTAAAAAGACAGAT

GACCAGAACAAACCACTTTCAAAAGCTACCTTTGTTTTAAAAACTACTGCTCATCCAGAAAGTAAAATAGAA

AAAGTAACTGCTGAGCTAACAGGTGAAGCTACTTTTGATAATCTCATACCTGGAGATTATACTTTATCAGAA

GAAACAGCGCCCGAAGGTTATAAAAAGACTAACCAGACTTGGCAAGTTAAGGTTGAGAGTAATGGAAAAACT

ACGATACAAAATAGTGGTGATAAAAATTCCACAATTGGACAAATCAGGAAGAACTAGATAAGCAGTATCCC

CCCACAGGAATTTATGAAGATACAAAGGAATCTTATAAACTTGAGCATGTTAAAGGTTCAGTTCCAAATGGA

AAGTCAGAGGCAAAAGCAGTTAACCCATATTCAAGTGAAGGTGAGCATATAAGAGAAATTCCAGAGGGAACA

TTATCTAAACGTATTTCAGAAGTAGGTGATTTAGCTCATAATAAATATAAAATTGAGTTAACTGTCAGTGGA

AAAACCATAGTAAAACCAGTGGACAAACAAAAGCCGTTAGATGTTGTCTTCGTACTCGATAATTCTAACTCA

ATGAATAACGATGGCCCAAATTTTCAAAGGCATAATAAAGCCAAGAAAGCTGCCGAAGCTCTTGGGACCGCA

GTAAAAGATATTTTAGGAGCAAACAGTGATAATAGGGTTGCATTAGTTACCTATGGTTCAGATATTTTTGAT

GGTAGGAGTGTAGATGTCGTAAAAGGATTTAAAGAAGATGATAAATATTATGGCCTTCAAACTAAGTTCACA

ATTCAGACAGAGAATTATAGTCATAAACAATTAACAAATAATGCTGAAGAGATTATAAAAAGGATTCCGACA

GAAGCTCCTAAAGCTAAGTGGGGATCTACTACCAATGGATTAACTCCAGAGCAACAAAAGGAGTACTATCTT

AGTAAAGTAGGAGAAACATTTACTATGAAAGCCTTCATGGAGGCAGATGATATTTTGAGTCAAGTAAATCGA

AATAGTCAAAAAATTATTGTTCATGTAACTGATGGTGTTCCTACGAGATCATATGCTATTAATAATTTTAAA

CTGGGTGCATCATATGAAAGCCAATTTGAACAAATGAAAAAAAATGGATATCTAAATAAAAGTAATTTTCTA

CTTACTGATAAGCCCGAGGATATAAAAGGAAATGGGGAGAGTTACTTTTTGTTTCCCTTAGATAGTTATCAA

ACACAGATAATCTCTGGAAACTTACAAAAACTTCATTATTTAGATTTAAATCTTAATTACCCTAAAGGTACA

TABLE 11-continued

Amino acid and encoding DNA sequences of gbs1478 proteins derived from different strains of S. agalactiae

TTTTATCGAAATGGACCAGTAAGAGAACATGGAACACCAACCAAACTTTATATAAATAGTTTAAAACAGAAA

AATTATGACATCTTTAATTTTGGTATAGATATATCTGGTTTTAGACAAGTTTATAATGAGGATTATAAGAAA

AATCAAGATGGTACTTTTCAAAAATTGAAAGAGGAAGCTTTTGAACTTTCAGATGGGGAAATAACAGAACTA

ATGAAGTCATTCTCTTCTAAACCTGAGTATTATACCCCGATAGTAACTTCATCCGATGCATCTAACAATGAA

ATTTTATCTAAAATTCAGCAACAATTTGAAAAGATTTTAACAAAAGAAAACTCAATTGTTAATGGAACTATA

GAAGATCCTATGGGTGACAAAATCAATTTACAGCTTGGCAACGGACAAACATTGCAACCAAGTGATTATACT

TTACAGGGAAATGATGGAAGTATAATGAAAGATAGCATTGCAACTGGTGGGCCTAATAATGATGGTGGAATA

CTTAAAGGGGTTAAATTAGAATACATCAAAAATAAACTCTACGTTAGAGGTTTGAACTTAGGGGAGGGACAA

AAAGTAACACTCACATATGATGTGAAACTAGATGACAGTTTTATAAGTAACAAATTCTATGACACTAATGGT

AGAACAACATTGAATCCTAAATCAGAGGATCCTAATACACTTAGAGATTTTCCAATCCCTAAAATTCGTGAT

GTGAGAGAATATCCTACAATAACGATTAAAAACGAGAAGAAGTTAGGTGAAATTGAATTTACAAAAGTTGAT

AAAGATAATAATAAGTTGCTTCTCAAAGGAGCTACGTTTGAACTTCAAGAATTTAATGAAGATTATAAACTT

TATTTACCAATAAAAAATAATAATTCAAAGTAGTGACGGGAGAAAACGGCAAAATTTCTTACAAAGATTTG

AAAGATGGCAAATATCAGTTAATAGAAGCAGTTTCGCCGAAGGATTATCAAAAAATTACTAATAAACCAATT

TTAACTTTTGAAGTTGTTAAAGGATCGATACAAAATATAATAGCTGTTAATAAACAGATTTCTGAATATCAT

GAGGAAGGTGACAAGCATTTAATTACCAACACGCATATTCCACCAAAAGGAATTATTCCGATGACAGGTGGG

AAAGGAATTCTATCTTTCATTTTAATAGGTGGATCTATGATGTCTATTGCAGGTGGAATTTATATTTGGAAA

AGATATAGAAATCTAGTGATATATCTAGAGAAAAAGATTAA

ORF amino acid sequence (SEQ ID NO: 201):

MRKYQKFSKILTLSLFCLSQIPLNTNVLGESTVPENGAKGKLVVKKTDDQNKPLSKATFVLKTTAHPESKIE

KVTAELTGEATFDNLIPGDYTLSEETAPEGYKKTNQTWQVKVESNGKTTIQNSGDKNSTIGQNQEELDKQYP

PTGIYEDTKESYKLEHVKGSVPNGKSEAKAVNPYSSEGEHIREIPEGTLSKRISEVGDLAHNKYKIELTVSG

KTIVKPVDKQKPLDVVFVLDNSNSMNNDGPNFQRHNKAKKAAEALGTAVKDILGANSDNRVALVTYGSDIFD

GRSVDVVKGFKEDDKYYGLQTKFTIQTENYSHKQLTNNAEEIIKRIPTEAPKAKWGSTTNGLTPEQQKEYYL

SKVGETFTMKAFMEADDILSQVNRNSQKIIVHVTDGVPTRSYAINNFKLGASYESQFEQMKKNGYLNKSNFL

LTDKPEDIKGNGESYFLFPLDSYQTQIISGNLQKLHYLDLNLNYPKGTFYRNGPVREHGTPTKLYINSLKQK

NYDIFNFGIDISGFRQVYNEDYKKNQDGTFQKLKEEAFELSDGEITELMKSFSSKPEYYTPIVTSSDASNNE

ILSKIQQQFEKILTKENSIVNGTIEDPMGDKINLQLGNGQTLQPSDYTLQGNDGSIMXDSIATGGPNNDGGI

LKGVKLEYIKNKLYVRGLNLGEGQKVTLTYDVKLDDSFISNKFYDTNGRTTLNPKSEDPNTLRDFPIPKIRD

VREYPTITIKNEKKLGEIEFTKVDKDNNKLLLKGATFELQEFNEDYKLYLPIKNNNSKVVTGENGKISYKDL

KDGKYQLIEAVSPKDYQKITNKPILTFEVVKGSIQNIIAVNKQISEYHEEGDKHLITNTHIPPKGIIPMTGG

KGILSFILIGGSMMSIAGGIYIWKRYKKSSDISREKD

Strain IC306
ORF DNA sequence (SEQ ID NO: 221):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAAACTACTGCTCATCCAGAAAGTAAAATAGAA

AAAGTAACTGCTGAGCTAACAGGTGAAGCTACTTTTGATAATCTCATACCTGGAGATTATACTTTATCAGAA

GAAACAGCGCCCGAAGGTTATAAAAAGACTAACCAGACTTGGCAAGTTAAGGTTGAGAGTAATGGAAAAACT

TABLE 11-continued

Amino acid and encoding DNA sequences of gbs1478 proteins derived from different strains of *S. agalactiae*

ACGATACAAAATAGTGGTGATAAAAATTCCACAATTGGACAAAATCAGGAAGAACTAGATAAGCAGTATCCC

CCCACAGGAATTTATGAAGATACAAAGGAATCTTATAAACTTGAGCATGTTAAAGGTTCAGTTCCAAATGGA

AAGTCAGAGGCAAAAGCAGTTAACCCATATTCAAGTGAAGGTGAGCATATAAGAGAAATTCCAGAGGGAACA

TTATCTAAACGTATTTCAGAAGTAGGTGATTTAGCTCATAATAAATATAAAATTGAGTTAACTGTCAGTGGA

AAAACCATAGTAAAACCAGTGGACAAACAAAAGCCGTTAGATGTTGTCTTCGTACTCGATAATTCTAACTCA

ATGAATAACGATGGCCCAAATTTTCAAAGGCATAATAAAGCCAAGAAAGCTGCCGAAGCTCTTGGGACCGCA

GTAAAAGATATTTTAGGAGCAAACAGTGATAATAGGGTTGCATTAGTTACCTATGGTTCAGATATTTTTGAT

GGTAGGAGTGTAGATGTCGTAAAAGGATTTAAAGAAGATGATAAATATTATGGCCTTCAAACTAAGTTCACA

ATTCAGACAGAGAATTATAGTCATAAACAATTAACAAATAATGCTGAAGAGATTATAAAAGGATTCCGACA

GAAGCTCCTAAAGCTAAGTGGGGATCTACTACCAATGGATTAACTCCAGAGCAACAAAAGGAGTACTATCTT

AGTAAAGTAGGAGAAACATTTACTATGAAAGCCTTCATGGAGGCAGATGATATTTTGAGTCAAGTAAATCGA

AATAGTCAAAAAATTATTGTTCATGTAACTGATGGTGTTCCTACGAGATCATATGCTATTAATAATTTTAAA

CTGGGTGCATCATATGAAAGCCAATTTGAACAAATGAAAAAAATGGATATCTAAATAAAAGTAATTTTCTA

CTTACTGATAAGCCCGAGGATATAAAAGGAAATGGGGAGAGTTACTTTTTGTTTCCCTTAGATAGTTATCAA

ACACAGATAATCTCTGGAAACTTACAAAAACTTCATTATTTAGATTTAAATCTTAATTACCCTAAAGGTACA

TTTTATCGAAATGGACCAGTAAGAGAACATGGAACACCAACCAAACTTTATATAAATAGTTTAAAACAGAAA

AATTATGACATCTTTAATTTTGGTATAGATATATCTGGTTTTAGACAAGTTTATAATGAGGATTATAAGAAA

AATCAAGATGGTACTTTTCAAAAATTGAAAGAGGAAGCTTTTGAACTTTCAGATGGGGAAATAACAGAACTA

ATGAAGTCATTCTCTTCTAAACCTGAGTATTATACCCCGATAGTAACTTCATCCGATGCATCTAACAATGAA

ATTTTATCTAAAATTCAGCAACAATTTGAAAAGATTTTAACAAAAGAAAACTCAATTGTTAATGGAACTATA

GAAGATCCTATGGGTGACAAAATCAATTTACAGCTTGGCAACGGACAAACATTGCAACCAAGTGATTATACT

TTACAGGGAAATGATGAAGTATAATGAAAGATAGCATTGCAACTGGTGGGCCTAATAATGATGGTGGAATA

CTTAAAGGGGTTAAATTAGAATACATCAAAAATAAACTCTACGTTAGAGGTTTGAACTTAGGGGAGGGACAA

AAAGTAACACTCACATATGATGTGAAACTAGATGACAGTTTTATAAGTAACAAATTCTATGACACTAATGGT

AGAACAACATTGAATCCTAAATCAGAGGATCCTAATACACTTAGAGATTTTCCAATCCCTAAAATTCGTGAT

GTGAGAGAATATCCTACAATAACGATTAAAAACGAGAAGAAGTTAGGTGAAATTGAATTTACAAAAGTTGAT

AAAGATAATAATAAGTTGCTTCTCAAAGGAGCTACGTTTGAACTTCAAGAATTTAATGAAGATTATAAACTT

TATTTACCAATAAAAAATAATAATTCAAAAGTAGTGACGGGAGAAAACGGCAAAATTTCTTACAAAGATTTG

AAAGATGGCAAATATCAGTTAATAGAAGCAGTTTCGCCGAAGGATTATCAAAAAATTACTAATAAACCAATT

TTAACTTTTGAAGTTGTTAAAGGATCGATACAAAATATAATAGCTGTTAATAAACAGATTTCTGAATATCAT

GAGGAAGGTGACAAGCATTTAATTACCAACACGCATATTCCACCAAAAGGAATTATTCCGATGACAGGTGGG

AAAGGAATTCTATCTTTCATTTTAATAGGTGGATCTATGATGTCTATTGCAGGTGGAATTTATATTTGGAAA

AGATATAAGAAATCTAGTGATATATCTAGAGAAAAAGATTAA

ORF amino acid sequence (SEQ ID NO: 202):

MRKYQKFSKILTLSLFCLSQIPLNTNVLGESTVPENGAKGKLVVKKTDDQNKPLSKATFVLKTTAHPESKIE

KVTAELTGEATFDNLIPGDYTLSEETAPEGYKKTNQTWQVKVESNGKTTIQNSGDKNSTIGQNQEELDKQYP

PTGIYEDTKESYKLEHVKGSVPNGKSEAKAVNPYSSEGEHIREIPEGTLSKRISEVGDLAHNKYKIELTVSG

KTIVKPVDKQKPLDVVFVLDNSNSMNNDGPNFQRHNKAKKAAEEALGTAVKDILGANSDNRVALVTYGSDIFD

TABLE 11-continued

Amino acid and encoding DNA sequences of gbs1478 proteins derived from different strains of *S. agalactiae*

GRSVDVVKGFKEDDKYYGLQTKFTIQTENYSHKQLTNNAEEIIKRIPTEAPKAKWGSTTNGLTPEQQKEYYL

SKVGETFTMKAFMEADDILSQVNRNSQKIIVHVTDGVPTRSYAINNFKLGASYESQFEQMKKNGYLNKSNFL

LTDKPEDIKGNGESYFLFPLDSYQTQIISGNLQKLHYLDLNLNYPKGTFYRNGPVREHGTPTKLYINSLKQK

NYDIFNFGIDISGFRQVYNEDYKKNQDGTFQKLKEEAFELSDGEITELMKSFSSKPEYYTPIVTSSDASNNE

ILSKIQQQFEKILTKENSIVNGTIEDPMGDKINLQLGNGQTLQPSDYTLQGNDGSIMKDSIATGGPNNDGGI

LKGVKLEYIKNKLYVRGLNLGEGQKVTLTYDVKLDDSFISNKFYDTNGRTTLNPKSEDPNTLRDFPIPKIRD

VREYPTITIKNEKKLGEIEFTKVDKDNNKLLLKGATFELQEFNEDYKLYLPIKNNNSKVVTGENGKISYKDL

KDGKYQLIEAVSPKDYQKITNKPILTFEVVKGSIQNIIAVNKQISEYHEEGDKHLITNTHIPPKGIIPMTGG

KGILSFILIGGSMMSIAGGIYIWKRYKKSSDISREKD

Strain IC458
ORF DNA sequence (SEQ ID NO: 222):

ATGAGAAAATACCAAAAATTTTCTAAAATATTGACGTTAAGTCTTTTTTGTTTGTCGCAAATACCGCTTAAT

ACCAATGTTTTAGGGGAAAGTACCGTACCGGAAAATGGTGCTAAAGGAAAGTTAGTTGTTAAAAAGACAGAT

GACCAGAACAAACCACTTTCAAAAGCTACCTTTGTTTTAAAAACTACTGCTCATCCAGAAAGTAAAATAGAA

AAAGTAACTGCTGAGGTAACAGGTGAAGCTACTTTTGATAATCTCACACCTGGAGATTACACTTTATCAGAA

GAAACGGCACCCGAAGGATACAAAAAGACTACCCAGACTTGGCAAGTTAAGGTTGAGAGTAATGGAAAAACT

ACGATACAAAATAGTGATGATAAAAAATCTATAATTGAACAAAGGCAAGAGGAACTAGATAAGCAGTATCCC

CTTACAGGAGCTTATGAAGATACAAAAGAATCTTATAATCTTGAGCATGTTAAAAATTCAATTCCAAATGGG

AAATTAGAGGCAAAAGCAGTTAATCCATATTCAAGTGAAGGTGAGCACATAAGAGAAATTCAAGAGGGAACA

TTATCTAAACGTATTTCAGAAGTAAATGATTTGGATCATAATAAATATAAAATTGAGTTAACTGTTAGCGGT

AAATCCATAATAAAAACTATAAATAAAGATGAACCTCTGGATGTTGTTTTTGTTCTTGATAATTCAAATTCT

ATGAAGAATAATGGAAAAAATAACAAGGCAAAAAGGCAGGTGAAGCAGTAGAAACAATTATAAAAGATGTT

TTAGGAGGAAATGTTGAAAACCGAGCAGCTTTAGTTACTTATGGTTCAGATATTTTTGATGGAAGGACAGTT

AAAGTTATAAAAGGTTTTAAAGAGGATCCTTATCATGGACTTGAAACTAGTTTCACAGTTCAGACAAATGAT

TATAGCTATAAAAAGTTCACTAATATTGCTGCTGATATTATAAAAAAGATCCCTAAAGAAGCTCCAGAAGCT

AAGTGGGGGGGACAAGTCTAGGATTAACTCCAGAAAAAAAGAGGGAATATGATTTAAGTAAAGTAGGTGAG

ACCTTTACAATGAAAGCTTTTATGGAGGCAGATACCTTGTTAAGTAGTATACAGCGTAAGAGTAGAAAGATT

ATTGTTCATCTAACTGACGGTGTTCCAACAAGATCATATGCTATTAATAGTTTTGTAACAGGTTCAACATAC

GCAAATCAATTTGAGAGAATAAAAGAAAAAGGTTATTTAGACAAAAATAATTATTTTATAAGTGATGATCCA

GAAAAGATCAAAGGCAATGGGGAGAGTTACTTTTTGTTTCCCTTAGATAGTTATCAAACACAGATAATTTCT

GGAAACTTACAAAAACTTCATTATTTAGATTTAAATCTTAATTACCCTAAAGGTACAATTTATAGAAATGGA

CCAGTAAGAGAACATGGAACACCAACCAAACTTTATATAAATAGTTTAAAACAGAAAAATTATGACATCTTT

AATTTTGGTATAGATATATCTGGTTTTAGACAAGTTTATAATGAGGATTATAAGAAAAATCAAGATGGTACT

TTTCAAAAATTGAAAGAGGAAGCTTTTGAACTTTCAGGTGGGGAAATAACAGAACTAATGAAGTCATTCTCT

TCTAAACCTGAGTATTATACCCCGATAGTAACTTCAGCTGATGTATCTAATAATGAAATTTTATCTAAAATT

CAGCAACAATTTGAAAAGATTTTAACAAAGGAAAACTCAATTGTTAATGGAACTATAGAAGATCCTATGGGT

GATAAAATCAATTTACAGCTTGGCAACGGACAAACATTGCAACCAAGTGATTATACTTTACAGGGAAATGAT

GGAAGTATAATGAAAGATAGCATTGCAACTGGTGGGCCTAATAATGATGGCGGGATACTTAAAGGGGTTAAA

TTAGAATACATCAAAAATAAACTCTACGTTAGAGGTTTGAACTTAGGGGAGGGGCAAAAAGTAACACTCACA

TABLE 11-continued

Amino acid and encoding DNA sequences of gbs1478 proteins derived from different strains of S. agalactiae

TATGATGTGAAACTAGATGACAGTTTTATTAGTAACAAATTCTATGACACTAATGGTAGAACAACATTGAAT

CCTAAATCAGAGGAACCTGATACACTTAGAGATTTTCCAATCCCTAAAATTCGTGATGTGAGAGAATATCCT

ACAATAACGATTAAAAACGAGAAGAAGTTAGGTGAAATTGAATTTACAAAAGTTGATAAAGATAATAATAAG

TTGCTTCTCAAAGGAGCTACATTTGAACTTCAAGAATTTAATGAAGATTATAAACTTTATTTACCAATAAAA

AATAATAATTCAAAGTAGTGACGGGAGAAAACGGCAAAATTTCTTACAAAGATTTGAAAGATGGCAAATAT

CAGTTAATAGAAGCAGTTTCGCCGAAGGATTATCAAAAAATTACTAATAAACCAATTTTAACTTTTGAAGTT

GTTAAAGGATCGATACAAAATATAATAGCTGTTAATAAACAGATTTCTGAATATCATGAGGAAGGTGACAAG

CATTTAATTACCAACACGCATATTCCACCAAAAGGAATTATTCCGATGACAGGTGGGAAAGGAATTCTATCT

TTCATTTTAATAGGTGGAGCTATGATGTCTATTGCAGGTGGAATTTATATTTGGAAAAAACATAAGAAATCT

AGTGATGCATCAATCGAGAAAGATTAA

ORF amino acid sequence (SEQ ID NO: 203):

MRKYQKFSKILTLSLFCLSQIPLNTNVLGESTVPENGAKGKLVVKKTDDQNKPLSKATFVLKTTAHPESKIE

KVTAEVTGEATFDHLTPGDYTLSEETAPEGYKKTTQTWQVKVESNGKTTIQNSDDKKSIIEQRQEELDKQYP

LTGAYEDTKESYNLEHVKNSIPNGKLEAKAVNPYSSEGEHIREIQEGTLSKRISEVNDLDHNKYKIELTVSG

KSIIKTINKDEPLDVVFVLDNSNSMKNNGKNNKAKKAGEAVETIIKDVLGANVENRAALVTYGSDIFDGRTV

KVIKGFKEDPYHGLETSFTVQTNDYSYKKFTNIAADIIKKIPKEAPEAKWGGTSLGLTPEKKREYDLSKVGE

TFTMKAFMEADTLLSSIQRKSRKIIVHLTDGVPTRSYAINSFVTGSTYANQFERIKEKGYLDKNNYFITDDP

EKIKGNGESYFLFPLDSYQTQIISGNLQKLHYLDLNLNYPKGTIYRNGPVREHGTPTKLYINSLKQKNYDIF

NFGIDISGFRQVYNEDYKKNQDGTFQKLKEEAFELSGGEITELMKSFSSKPEYYTPIVTSADVSNNEILSKI

QQQFEKILTKENSIVNGTIEDPMGDKINLQLGNGQTLQPSDYTLQGNDGSIMKDSIATGGPNNDGGILKGVK

LEYIKNKLYVRGLNLGEGQKVTLTYDVKLDDSFISNKFYDTNGRTTLNPKSEEPDTLRDFPIPKIRDVREYP

TITIKNEKKLGEIEFTKVDKDNNKLLLKGATFELQEFNEDYKLYLPIKNNNSKVVTGENGKISYKDLKDGKY

QLIEAVSPKDYQKITNKPILTFEVVKGSIQNIIAVNKQISEYHEEGDKHLITNTHIPPKGIIPMTGGKGILS

FILIGGAMMSIAGGIYIWKKHKKSSDASIEKD

TABLE 12

Amino acid and encoding DNA sequences of gbs2018 proteins derived from different strains of S. agalactiae Strain 0176H4A
ORF DNA sequence (SEQ ID NO: 180):

ATGAATAATAACGAAAAAAAGTAAAATACTTTTTAAGAAAAACAGCTTATGGTTTGGCCTCAATGTCAGCA

GCGTTTGCTGTATGTAGTGGTATTGTACACGCGGATACTAGTTCAGGAATATCGGATTCAATTCCTCATAAG

AAACAAGTTAATTTAGGGGCGGTTACTCTGAAGAATTTGATTTCTAAATATCGTGGTAATGACAAAGCTATT

GCTATACTTCTAAGTAGAGTAGATGATTTAATAGAGCATCACAGGATACACTTCCACAATTAATTAATAGT

ACTGAAGCAGAAATTAACAATACTTTACCTCAGGGACGAATTATTAAACAGAGTATACCAGTCGTAAGATTA

AAAGTTGAGAGATTGGAAGTGGTGCAATTAAGGCTGAGTCGATTAATAATATTAAAGCTGAATCAATTAAT

AAAATTCAGGGTAAATCAACTAATACAATTAAGGCTGAGTCCATTAATAAAATTAAAGTAGAGTCTATTAAT

ACAATCAAAGCCGAATCAATTAATAAAATTCAAGCTAAGCCAATTAACACAATCAAAGCCGAGTCTATTAAT

ACAATTAAGGCTGAATCAATTCATAAAATTAAACCTCAATCAATAAAAAGTACTAGTGCTACACATGTTAAA

TABLE 12-continued

Amino acid and encoding DNA sequences of gbs2018 proteins derived from different strains of S. agalactiae

GTTAGTGATCAAGAACTAGCTAAGCAGTCAAGACGTTCTCAAGATATCATTAAATCATTAGGTTTCCTTTCA

TCAGACCAAAAAGATATTTTAGTTAAATCTATTAGCTCTTCAAAAGATTCGCAACTTATTCTTAAATTTGTA

ACACAAGCCACGCAACTGAATAATGCTGAATCAACAAAAGCTAAGCACATGGCTCAAAATGACGTGGCTTCA

ATAAAAAATATAAGCCTCGAAGTCTTAGAAGAATATAAAGAAAAAATTCAAAGAGCTAGCACTAAGAGTCAA

GTTGATGAGCTTGTAGCAGAAGCTAAAAAAGTTGTTAATTCCAATAAAGAAACATTGGTAAATCAGGCCAAT

GGTAAAAAGCAAGAAATTGCTAAGTTAGAAAATTTATCTAACGATGAAATGTTGAGATATAATACTGCAATT

GATAATGTAGTGAAACAGTATAATGAAGGTAAGCTCAATATTACTGATGCAATGAATGCTTTAAATAGTATT

AAGCAAGCAGCACAGGAAGTTGCCCAGAAAAACTTACAAAAGCAGTATGCTAAAAAAATTGAAAGAATAAGT

TTAAAAGGATTAGCGTTATCCAAAAAGGCTAAAGAAATTTATGAAAAGCATAAAAGTATTTTGCCTACACCT

GGATATTATGCAGACTCTGTGGGAACTTATTTGAATAGGTTTAGAGATAAACGAACTTTCGGAAATAGAAGT

GTTTGGACTGGTCAAAGTGGACTTGATGAAGCAAAAAAAATGCTTGATGAAGTCAAAAAGCTTTTAAAAGAA

CTTCAAGACCTTACCAGAGGTACTAAAGAAGATAAAAAACCAGACGTTAAGCCAGAAGCCAAACCAGAGGCC

AAACCAAATATTCAAGTACCTAAACAAGCACCTACAGAAGCTGCAAAACCAGCTTTGTCACCAGAAGCCTTG

ACAAGATTGACTACATGGTATAATCAAGCTAAAGATCTGCTTAAAGATGATCAAGTAAAGGACAAATATGTA

GATATACTTGCAGTTCAAAAAGCTGTTGACCAAGCTTATGATCATGTGGAAGAGGGAAAATTTATTACCACT

GATCAAGCAAATCAATTAGCTAACAAGCTACGTGATGCTTTACAAAGTTTAGAATTAAAAGATAAAAAGTA

GCCAAACCAGAAGCTAAGCCAGAAGTTAAACCAGAAGCCAAACCAGATGTTAAGCCAGACGTTAAGCCAGAA

GCTAAGCCAGAAGCCAAACCAGAGGCCAAACCAGAAGGCAAACCAGAGGCCAAACCAGAAGCCAAACCAGAG

GCTAAGCCAGAAGTTAAACCAGACGTTAAGCCAGAGGCCAAACCAGACGTTAAGCCAGAAGCCAAACCAGAC

GTTAAGCCAGAGGCTAAGCCAGAAGTTAAACCAGACGTTAAGCCAGAAGTTAAACCAGAGGCTAAACCAGAA

ATTAAACCAGACGTTAAGCCAGAGGCCAGACCAGAGGCTAAGCCAGAAGTTAAACCAGACGTTAAGCCAGAG

GCCAAACCAGAAGTTAAACCAGACGTTAAGCCAGAGGCCAAACCAGAGGCTAAGCCAGAAGTTAAACCAGAC

GTTAAGCCAGAGGCTAAACCAGAAGCCAAACCAGCAACCAAAAAATCGGTTAATACTAGCGGAAACTTGGCG

GCTAAAAAGCTATTGAAAACAAAAAGTATAGTAAAAAATTACCATCAACGGGTGAAGCCGCAAGTCCACTC

TTAGCAATTGTATCACTAATTGTTATGTTAAGTGCAGGTCTTATTACGATAGTTTTAAAGCATAAAAAAAAT

TAA

ORF amino acid sequence (SEQ ID NO: 175):

MNNNEKKVKYFLRKTAYGLASMSAAFAVCSGIVHADTSSGISDSIPHKKQVNLGAVTLKNLISKYRGNDKAI

AILLSRVDDFNRASQDTLPQLINSTEAEINNTLPQGRIIKQSIPVVRLKVERLGSGAIKAESINNIKAESIN

KIQGKSTNTIKAESINKIKVESINTIKAESINKIQAKPINTIKAESINTIKAESIHKIKPQSIKSTSATHVK

VSDQELAKQSRRSQDIIKSLGFLSSDQKDILVKSISSSKDSQLILKFVTQATQLNNAESTKAKHMAQNDVAS

IKNISLEVLEEYKEKIQRASTKSQVDELVAEAKKVVNSNKETLVNQANGKKQEIAKLENLSNDEMLRYNTAI

DNVVKQYNEGKLNITDAMNALNSIKQAAQEVAQKNLQKQYAKKIERISLKGLALSKKAKEIYEKHKSILPTP

GYYADSVGTYLNRFRDKRTFGNRSVWTGQSGLDEAKKMLDEVKKLLKELQDLTRGTKEDKKPDVKPEAKPEA

KPNIQVPKQAPTEAAKPALSPEALTRLTTWYNQAKDLLKDDQVKDKYVDILAVQKAVDQAYDHVEEGKFITT

DQANQLANKLRDALQSLELKDKKVAKPEAKPEVKPEAKPDVKPDVKPEAKPEAKPEAKPEAKPEAKPEAKPE

AKPEVKPDVKPEAKPDVKPEAKPDVKPEAKPEVKPDVKPEVKPEAKPEIKPDVKPEARPEAKPEVKPDVKPE

TABLE 12-continued

Amino acid and encoding DNA sequences of gbs2018 proteins derived from different strains of *S. agalactiae*

AKPEVKPDVKPEAKPEAKPEVKPDVKPEAKPEAKPATKKSVNTSGNLAAKKAIENKKYSKKLPSTGEAASPL

LAIVSLIVMLSAGLITIVLKHKKN

Strain 12401
ORF DNA sequence (SEQ ID NO: 181):

ATGAATAATAACGAAAAAAAGTAAAATACTTTTTAAGAAAAACAGCTTATGGTTTGGCCTCAATGTCAGCA

GCGTTTGCTGTATGTAGTGGTATTGTACACGCGGATACTAGTTCAGGAATATCGGATTCAATTCCTCATAAG

AAACAAGTTAATTTAGGGGCGGTTACTCTGAAGAATTTGATTTCTAAATATCGTGGTAATGACAAAGCTATT

GCTATACTTTTAAGTAGAGTAAATGATTTTAATAGAGCATCACAGGATACACTTCCACAATTAATTAATAGT

ACTGAAGCAGAAATTAACAATACTTTACCTCAGGGACGAATTATTAAACAGAGTATACCAGTCGTAAGATTA

AAAGTTGAGAGATTGGGAAGTGGTGCAATTAAGGCTGAGTCGATTAATAATATTAAAGCTGAATCAATTAAT

AAAATTCAGGGTAAATCAACTAATACAATTAAGGCTGAGTCCATTAATAAAATTAAAGTAGAGTCTATTAAT

ACAATCAAAGCCGAATCAATTAATAAAATTCAAGCTAAGCCAATTAACACAATCAAAGCCGAGTCTATTAAT

ACAATTAAGGCTGAATCAATTCATAAAATTAAACCTCAATCAATAAAAAGTACTAGTGCTACACATGTTAAA

GTTAGTGATCAAGAACTAGGTAAGCAGTCAAGACGTTCTCAAGATATCATTAAATCATTAGGTTTCCTTTCA

TCAGACCAAAAAGATATTTTAGTTAAATCTATTAGCTCTTCAAAAGATTCGCAACTTATTCTTAAATTTGTA

ACACAAGCCACGCAACTGAATAATGCTGAATCAACAAAAGCTAAGCACATGGCTCAAAATGACGTGGCTTCA

ATAAAAAATATAAGCCTCGAAGTCTTAGAAGAATATAAAGAAAAAATTCAAAGAGCTAGCACTAAGAGTCAA

GTTGATGAGCTTGTAGCAGAAGCTAAAAAAGTTGTTAATTCCAATAAAGAAACATTGGTAAATCAGGCCAAT

GGTAAAAAGCAAGAAATTGCTAAGTTAGAAAATTTATCTAACGATGAAATGTTGAGATATAATACTGCAATT

GATAATGTAGTGAAACAGTATAATGAAGGTAAGCTCAATATTACTGATGCAATGAATGCTTTAAATAGTATT

AAGCAAGCAGCACAGGAAGTTGCCCAGAAAAACTTACAAAAGCAGTATGCTAAAAAAATTGAAAGAATAAGT

TTAAAAGGATTAGCGTTATCCAAAAAGGCTAAAGAAATTTATGAAAAGCATAAAAGTATTTTGCCTACACCT

GGATATTATGCAGACTCTGTGGGAACTTATTTGAATAGGTTTAGAGATAAACGAACTTTCGGAAATAGAAGT

GTTTGGACTGGTCAAAGTGGACTTGATGAAGCAAAAAAAATGCTTGATGAAGTCAAAAAGCTTTTAAAAGAA

CTTCAAGACCTTACCAGAGGTACTAAAGAAGATAAAAAACCAGACGTTAAGCCAGAAGCCAAACCAGAGGCC

AAACCAAATATTCAAGTACCTAAACAAGCACCTACAGAAGCTGCAAAACCAGCTTTGTCACCAGAAGCCTTG

ACAAGATTGACTACATGGTATAATCAAGCTAAAGATCTGCTTAAAGATGATCAAGTAAAGGACAAATATGTA

GATATACTTGCAGTTCAAAAAGCTGTTGACCAAGCTTATGATCATGTGGAAGAGGGAAAATTTATTACCACT

GATCAAGCAAATCAAITAGCTAACAAGCTACGTGATGCTTTACAAAGTTTAGAATTAAAAGATAAAAAGTA

GCCAAACCAGAAGCTAAGCCAGAAGTTAAACCAGAAGCCAAACCAGAGGCCAAACCAGAAGCCAAACCAGAG

GCTAAGCCAGAAGTTAAACCAGACGTTAAGCCAGAGGCCAAACCAGACGTTAAGCCAGAAGCCAAACCAGAC

GTTAAGCCAGAAGTTAAACCAGACGTTAAGCCAGAGGCCAAACCAGACGTTAAGCCAGAAGCTAAGCCAGAC

GTTAAGCCAGAAGTTAAACCAGAGGCTAAGCCAGAAGCCAAACCAGAGGCTAAACCAGAAATTAAACCAGAC

GTTAAGCCAGAGGCCAGACCAGAGGCTAAGCCAGAAGTTAAACCAGACGTTAAGCCAGAGGCCAAACCAGAG

GTTAAGCCAGAAGTTAAACCAGACGTTAAGCCAGAGGCTAAACCAGAAGCCAAACCAGCAACCAAAAAATCG

GTTAATACTAGCGGAAACTTGGCGGTTAAAAAAGCTATTGAAAACAAAAAGTATAGTAAAAAATTACCATCA

ACGGGTGAAGCCGCAAGTCCACTCTTAGCAATTGTATCACTAATTGTTATGTTAAGTGCAGGTCTTATTACG

ATAGTTTTAAAGCATAAAAAAAATTAA

TABLE 12-continued

Amino acid and encoding DNA sequences of gbs2018 proteins derived from different strains of S. agalactiae ORF amino acid sequence (SEQ ID NO: 176):

MNNNEKKVKYFLRKTAYGLASMSAAFAVCSGIVHADTSSGISDSIPHKKQVNLGAVTLKNLISKYRGNDKAI
AILLSRVNDFNRASQDTLPQLINSTEAEINNTLPQGRIIKQSIPVVRLKVERLGSGAIKAESINNIKAESIN
KIQGKSTNTIKAESINKIKVESINTIKAESINKIQAKPINTIKAESINTIKAESIHKIKPQSIKSTSATHVK
VSDQELGKQSRRSQDIIKSLGFLSSDQKDILVKSISSSKDSQLILKFVTQATQLNNAESTKAKHMAQNDVAS
IKNISLEVLEEYKEKIQRASTKSQVDELVAEAKKVVNSNKETLVNQANGKKQEIAKLENLSNDEMLRYNTAI
DNVVKQYNEGKLNITDAMNALNSIKQAAQEVAQKNLQKQYAKKIERISLKGLALSKKAKEIYEKHKSILPTP
GYYADSVGTYLNRFRDKRTFGNRSVWTGQSGLDFAKKMLDEVKKLLKELQDLTRGTKEDKKPDVKPEAKPEA
KPNIQVPKQAPTEAAKPALSPEALTRLTTWYNQAKDLLKDDQVKDKYVDILAVQKAVDQAYDHVEEGKFITT
DQANQLANKLRDALQSLELKDKKVAKPEAKPEVKPEAKPEAKPEAKPEVKPDVKPEAKPDVKPEAKPD
VKPEVKPDVKPEAKPDVKPEAKPDVKPEVKPEAKPEAKPEAKPEIKPDVKPEARPEAKPEVKPDVKPEAKPE
VKPEVKPDVKPEAKPEAKPATKKSVNTSGNLAVKKAIENKKYSKKLPSTGEAASPLLAIVSLIVMLSAGLIT
IVLKHKKN

Strain BAA23
ORF DNA sequence (SEQ ID NO: 182):

ATGAATAATAACGAAAAAAAGTAAAATACTTTTTAAGAAAAACAGCTTATGGTTTGGCCTCAATGTCAGCA
GCGTTTGCTGTATGTAGTGGTATTGTACACGCGGATACTAGTTCAGGAATATCGGATTCAATTCCTCATAAG
AAACAAGTTAATTTAGGGGCGGTTACTCTGAAGAATTTGATTTCTAAATATCGTGGTAATGACAAAGCTATT
GCTATACTTCTAAGTAGAGTAGATGATTTTAATAGAGCATCACAGGATACACTTCCACAATTAATTAATAGT
ACTGAAGCAGAAATTAACAATACTTTACCTCAGGGACGAATTATTAAACAGAGTATACCAGTCGTAAGATTA
AAAGTTGAGAGATTGGAAGTGGTGCAATTAAGGCTGAGTCGATTAATAATATTAAAGCTGAATCAATTAAT
AAAATTCAGGGTAAATCAACTAATACAATTAAGGCTGAGTCCATTAATAAAATTAAAGTAGAGTCTATTAAT
ACAATCAAAGCCGAATCAATTAATAAAATTCAAGCTAAGCCAATTAACACAATCAAAGCCGAGTCTATTAAT
ACAATTAAGGCTGAATCAATTCATAAAATTAAACCTCAATCAATAAAAAGTACTAGTGCTACACATGTTAAA
GTTAGTGATCAAGAACTAGCTAAGCAGTCAAGACGTTCTCAAGATATCATTAAATCATTAGGTTTCCTTTCA
TCAGACCAAAAAGATATTTTAGTTAAATCTATTAGCTCTTCAAAAGATTCGCAACTTATTCTTAAATTTGTA
ACACAAGCCACGCAACTGAATAATGCTGAATCAACAAAAGCTAAGCACATGGCTCAAAATGACGTGGCTTCA
ATAAAAAATATAAGCCTCGAAGTCTTAGAAGAATATAAAGAAAAAATTCAAAGAGCTAGCACTAAGAGTCAA
GTTGATGAGCTTGTAGCAGAAGCTAAAAAAGTTGTTAATTCCAATAAAGAAACATTGGTAAATCAGGCCAAT
GGTAAAAAGCAAGAAATTGCTAAGTTAGAAAATTTATCTAACGATGAAATGTTGAGATATAATACTGCAATT
GATAATGTAGTGAAACAGTATAATGAAGGTAAGCTCAATATTACTGATGCAATGAATGCTTTAAATAGTATT
AAGCAAGCAGCACAGGAAGTTGCCCAGAAAAACTTACAAAAGCAGTATGCTAAAAAAATTGAAAGAATAAGT
TTAAAAGGATTAGCGTTATCCAAAAAGGCTAAAGAAATTTATGAAAAGCATAAAAGTATTTTGCCTACACCT
GGATATTATGCAGACTCTGTGGGAACTTATTTGAATAGGTTTAGAGATAAACGAACTTTCGGAAATAGAAGT
GTTTGGACTGGTCAAAGTGGACTTGATGAAGCAAAAAAAATGCTTGATGAAGTCAAAAAGCTTTTAAAAGAA
CTTCAAGACCTTACCAGAGGTACTAAAGAAGATAAAAAACCAGACGTTAAGCCAGAAGCCAAACCAGAGGCC
AAACCAAATATTCAAGTACCTAAACAAGCACCTACAGAAGCTGCAAAACCAGCTTTGTCACCAGAAGCCTTG
ACAAGATTGACTACATGGTATAATCAAGCTAAAGATCTGCTTAAAGATGATCAAGTAAAGGACAAATATGTA
GATATATTTGCAGTTCAAAAAGCTGTTGACCAAGCTTATGATCATGTGGAAGAGGGAAAATTTATTACCACT

TABLE 12-continued

Amino acid and encoding DNA sequences of gbs2018 proteins derived from different strains of *S. agalactiae*

GATCAAGCAAATCAATTAGCTAACAAGATACGTGATGCTTTACAAAGTTTAGAATTAAAAGATAAAAAGTA

GCCAAACCAGAGGGTAAGCCAGAAGTTAAACCAGACGTTAAGCCAGAGGCCAAACCAGACGTTAAGCCAGAA

GCCAAACCAGACGTTAAGCCAGAAGTTAAACCAGACGTTAAGCCAGAGGCCAAACCAGACGTTAAGCCAGAA

GCTAAGCCAGACGTTAAGCCAGAAGTTAAACCAGAGGCTAAGCCAGAAGTTAAACCAGACGTTAAGCCAGAG

GCCAGACCAGAGGCTAAGCCAGAAGTTAAACCAGACGTTAAGCCAGAGGCCAAACCAGAGGCTAAGCCAGAA

GTTAAACCAGACGTTAAGCCAGAGGCTAAACCAGAAGCCAAACCAGCAACCAAAAAATCGGTTAATACTAGC

GGAAACTTGGCGGTTAAAAAAGCTATTGAAAACAAAAAGTATAGTAAAAAATTACCATCAACGGGTGAAGCC

GCAAGTCCACTCTTAGCAATTGTATCACTAATTGTTATGTTAAGTGCAGGTCTTATTACGATAGTTTTAAAG

CATAAAAAAATTAA

ORF amino acid sequence (SEQ ID NO: 177):

MNNNEKKVKYFLRKTAYGLASMSAAFAVCSGIVHADTSSGISDSIPHKKQVNLGAVTLKNLISKYRGNDKAI

AILLSRVDDFNRASQDTLPQLINSTEAEINNTLPQGRIIKQSIPVVRLKVERLGSGAIKAESINNIKAESIN

KIQGKSTNTIKAESINKIKVESINTIKAESINKIQAKPINTIKAESINTIKAESIHKIKPQSIKSTSATHVK

VSDQELAKQSRRSQDIIKSLGFLSSDQKDILVKSISSSKDSQLILKFVTQATQLNNAESTKAKHMAQNDVAS

IKNISLEVLEEYKEKIQRASTKSQVDELVAEAKKVVNSNKETLVNQANGKKQEIAKLENLSNDEMLRYNTAI

DNVVKQYNEGKLNITDAMNALNSIKQAAQEVAQKNLQKQYAKKIERISLKGLALSKKAKEIYEKHKSILPTP

GYYADSVGTYLNRFRDKRTFGNRSVWTGQSGLDEAKKMLDEVKKLLKELQDLTRGTKEDKKPDVKPEAKPEA

KPNIQVPKQAPTEAAKPALSPEALTRLTTWYNQAKDLLKDDQVKDKYVDIFAVQKAVDQAYDHVEEGKFITT

DQANQLANKIRDALQSLELKDKKVAKPEGKPEVKPDVKPEAKPDVKPEAKPDVKPEVKPDVKPEAKPDVKPE

AKPDVKPEVKPEAKPEVKPDVKPEARPEAKPEVKPDVKPEAKPEAKPEVKPDVKPEAKPEAKPATKKSVNTS

GNLAVKKAIENKKYSKKLPSTGEAASPLLAIVSLIVMLSAGLITIVLKHKKN

Strain IC105
ORF DNA sequence (SEQ ID NO: 183):

ATGAATAATAACGAAAAAAAGTAAAATACTTTTTAAGAAAAACAGCTTATGGTTTGGCCTCAATGTCAGCA

GCGTTTGCTGTATGTAGTGGTATTGTACACGCGGATACTAGTTCAGGAATATCGGATTCAATTCCTCATAAG

AAACAAGTTAATTTAGGGGCGGTTACTCTGAAGAATTTGATTTCTAAATATCGTGGTAATGACAAAGCTATT

GCTATACTTCTAAGTAGAGTAGATGATTTTAATAGAGCATCACAGGATACACTTCCACAATTAATTAATAGT

ACTGAAGCAGAAATTAACAATACTTTACCTCAGGGACGAATTATTAAACAGAGTATACCAGTCGTAAGATTA

AAAGTTGAGAGATTGGGAAGTGGTGCAATTAAGGCTGAGTCGATTAATAATATTAAAGCTGAATCAATTAAT

AAAATTCAGGGTAAATCAACTAATACAATTAAGGCTGAGTCCATTAATAAAATTAAAGTAGAGTCTATTAAT

ACAATCAAAGCCGAATCAATTAATAAAATTCAAGCTAAGCCAATTAACACAATCAAAGCCGAGTCTATTAAT

ACAATTAAGGCTGAATCAATTCATAAAATTAAACCTCAATCAATAAAAAGTACTAGTGCTACACATGTTAAA

GTTAGTGATCAAGAACTAGGTAAGCAGTCAAGACGTTCTCAAGATATCATTAAATCATTAGGTTTCCTTTCA

TCAGACCAAAAAGATATTTTAGTTAAATCTATTAGCTCTTCAAAAGATTCGCAACTTATTCTTAAATTTGTA

ACACAAGCCACGCAACTGAATAATGCTGAATCAACAAAAGCTAAGCACATGGCTCAAAATGACGTGGCTTCA

ATAAAAAATATAAGCCTCGAAGTCTTAGAAGAATATAAAGAAAAAATTCAAAGAGCTAGCACTAAGAGTCAA

GTTGATGAGCTTGTAGCAGAAGCTAAAAAAGTTGTTAATTCCAATAAAGAAACATTGGTAAATCAGGCCAAT

GGTAAAAAGCAAGAAATTGCTAAGTTAGAAAATTTATCTAACGATGAAATGTTGAGATATAATACTGCAATT

GATAATGTAGTGAAACAGTATAATGAAGGTAAGCTCAATATTACTGATGCAATGAATGCTTTAAATAGTATT

TABLE 12-continued

Amino acid and encoding DNA sequences of gbs2018 proteins derived from different strains of *S. agalactiae*

AAGCAAGCAGCACAGGAAGTTGCCCAGAAAAACTTACAAAAGCAGTATGCTAAAAAAATTGAAAGAATAAGT

TTAAAAGGATTAGCGTTATCCAAAAAGGCTAAAGAAATTTATGAAAAGCATAAAAGTATTTTGCCTACACCT

GGATATTATGCAGACTCTGTGGGAACTTATTTGAATAGGTTTAGAGATAAACGAACTTTCGGAAATAGAAGT

GTTTGGACTGGTCAAAGTGGACTTGATGAAGCAAAAAAAATGCTTGATGAAGTCAAAAAGCTTTTAAAAGAA

CTTCAAGACCTTACCAGAGGTACTAAAGAAGATAAAAAACCAGACGTTAAGCCAGAAGCCAAACCAGAGGCC

AAACCAAATATTCAAGTACCTAAACAAGCACCTACAGAAGCTGCAAAACCAGCTTTGTCACCAGAAGCCTTG

ACAAGATTGACTACATGGTATAATCAAGCTAAAGATCTGCTTAAAGATGATCAAGTAAAGGACAAATATGTA

GATATACTTGCAGTTCAAAAAGCTGTTGACCAAGCTTATGATCATGTGGAAGAGGGAAAATTTATTACCACT

GATCAAGCAAATCAATTAGCTAACAAGCTACGTGATGCTTTACAAAGTTTAGAATTAAAAGATAAAAAGTA

GCCAAACCAGAAGCTAAGCCAGAAGTTAAACCAGAAGCCAAACCAGATGTTAAGCCAGACGTTAAGCCAGAA

GCTAAGCCAGAAGCCAAACCAGAGGCCAAACCAGAAGCCAAACCAGAGGCCAAACCAGAAGCCAAACCAGAG

GCTAAGCCAGAAGTTAAACCAGACGTTAAGCCAGAGGCCAAACCAGACGTTAAGCCAGAAGCCAAACCAGAC

GTTAAGCCAGAGGCTAAGCCAGAAGTTAAACCAGACGTTAAGCCAGAGGCCAAACCAGACGTTAAGCCAGAA

GCTAAGCCAGACGTTAAGCCAGAAGTTAAACCAGAGGCTAAGCCAGAAGTTAAACCAGACGTTAAGCCAGAG

GCCAGACCAGAGGCTAAGCCAGAAGTTAAACCAGACGTTAAGCCAGAGGCCAAACCAGAGGCTAAGCCAGAA

GTTAAACCAGACGTTAAGCCAGAGGCTAAACCAGAAGCTAAACCAGCAACCAAAAAATCGGTTAATACTAGC

GGAAACTTGGCGGTTAAAAAAGCTATTGAAAACAAAAAGTATAGTAAAAAATTACCATCAACGGGTGAAGCC

GCAAGTCCACTCTTAGCAATTGTATCACTAATTGTTATGTTAAGTGCAGGTCTTATTACGATAGTTTTAAAG

CATAAAAAAAATTAA

ORF amino acid sequence (SEQ ID NO: 178):

MNNNEKKVKYFLRKTAYGLASMSAAFAVCSGIVHADTSSGISDSIPHKKQVNLGAVTLKNLISKYRGNDKAI

AILLSRVDDFNRASQDTLPQLINSTEAEINNTLPQGRIIKQSIPVVRLKVERLGSGAIKAESINNIKAESIN

KIQGKSTNTIKAESINKIKVESINTIKAESINKIQAKPINTIKAESINTIKAESIHKIKPQSIKSTSATHVK

VSDQELGKQSRRSQDIIKSLGFLSSDQKDILVKSISSSKDSQLILKFVTQATQLNNAESTKAKHMAQNDVAS

IKNISLEVLEEYKEKIQRASTKSQVDELVAEAKKVVNSNKETLVNQANGKKQEIAKLENLSNDEMLRYNTAI

DNVVKQYNEGKLNITDAMNALNSIKQAAQEVAQKNLQKQYAKKIERISLKGLALSKKAKEIYEKHKSILPTP

GYYADSVGTYLNRFRDKRTFGNRSVWTGQSGLDEAKKMLDEVKKLLKELQDLTRGTKEDKKPDVKPEAKPEA

KPNIQVPKQAPTEAAKPALSPEALTRLTTWYNQAKDLLKDDQVKDKYVDILAVQKAVDQAYDHVEEGKFITT

DQANQLANKLRDALQSLELKDKKVAKPEAKPEVKPEAKPDVKPDVKPEAKPEAKPEAKPEAKPEAKPEAKPE

AKPEVKPDVKPEAKPDVKPEAKPDVKPEAKPEVKPDVKPEAKPDVKPEAKPDVKPEVKPEAKPEVKPDVKPE

ARPEAKPEVKPDVKPEAKPEAKPEVKPDVKPEAKPEAKPATKKSVNTSGNLAVKKAIENKKYSKKLPSTGEA

ASPLLAIVSLIVMLSAGLITIVLKHKKN

Strain IC458
ORF DNA sequence (SEQ ID NO: 184):

ATGAATAATAACGAAAAAAAGTAAAATACTTTTTAAGAAAAACAGCTTATGGTTTGGCCTCAATGTCAGCA

GCGTTTGCTGTATGTAGTGGTATTGTACACGCGGATACTAGTTCAGGAATATCGGCTTCAATTCCTCATAAG

AAACAAGTTAATTTAGGGGCGGTTACTCTGAAGAATTTGATTTCTAAATATCGTGGTAATGACAAAGCTATT

GCTATACTTTTAAGTAGAGTAAATGATTTTAATAGAGCATCACAGGATACACTTCCACAATTAATTAATAGT

ACTGAAGCAGAAATTAGAAATATTTTATATCAAGGACAAATTGGTAAGCAAAATAAACCAAGTGTAACTACA

TABLE 12-continued

Amino acid and encoding DNA sequences of gbs2018 proteins derived from different strains of *S. agalactiae*

CATGCTAAAGTTAGTGATCAAGAACTAGGTAAGCAGTCAAGACGTTCTCAAGATATCATTAAGTCATTAGGT

TTCCTTTCATCAGACCAAAAAGATATTTTAGTTAAATATATTAGCTCTTCAAAAGATTCGCAACTTATTCTT

AAATTTGTAACTCAAGCCACGCAACTGAATAATGCTGAATCAACAAAAGCTAAGCAAATGGCTCAAAATGAC

GTGGCCTTAATAAAAAATATAAGCCCCGAAGTCTTAGAAGAATATAAAGAAAAAATTCAAAGAGCTAGCACT

AAGAGTCAAGTTGATGAGTTTGTAGCAGAAGCTAAAAAAGTTGTTAATTCCAATAAAGAAACGTTGGTAAAT

CAGGCCAATGGTAAAAAGCAAGAAATTGATAAGTTAGAAAATTTATCTAACGATGAAATGTTGAGATATAAT

ACTGCAATTGATAATGTAGTGAAACAGTATAATGAAGGTAAGCTCAATATTACTGCTGCAATGAATGCTTTA

AATAGTATTAAGCAAGCAGCACAGGAAGTTGCCCAGAAAAACTTACAAAAGCAGTATGCTAAAAAAATTGAA

AGAATAAGTTCAAAAGGATTAGCGTTATCTAAAAAGGCTAAAGAAATTTATGAAAAGCATAAAAGTATTTTG

CCTACACCTGGATATTATGCAGACTCTGTGGGAACTTATTTGAATAGGTTTAGAGATAAACAAACTTTCGGA

AATAGGAGTGTTTGGACTGGTCAAAGTGGACTTGATGAAGCAAAAAAAATGCTTGATGAAGTCAAAAAGCTT

TTAAAAGAACTTCAAGACCTTACCAGAGGTACTAAAGAAGATAAAAAACCAGACGTTAAGCCAGAAGCCAAA

CCAGAGGCCAAACCAAATATTCAAGTACCTAAACAAGCACCTACAGAAGCTGCAAAACCAGCTTTGTCACCA

GAAGCCTTGACAAGATTGACTACATGGTATAATCAAGCTAAAGATCTGCTTAAAGATGATCAAGTAAAGGAC

AAATACGTAGATATACTTGCAGTTCAAAAAGCTGTTGACCAAGCTTATGATCATGTGGAAGAGGGAAAATTT

ATTACCACTGATCAAGCAAATCAATTAGCTAACAAGCTACGTGATGCTTTACAAAGTTTAGAATTAAAAGAT

AAAAAAGTAGCCAAACCAGAAGCCAAACCAGAGGCCAAACCAGAAGCTAAGCCAGAAGCTAAGCCAGAAGCT

AAGCCAGAAGCTAAGCCAGAGGCCAAACCAGAAGCTAAGCCAGACGTTAAGCCAGAAGCTAAACCAGACGTT

AAACCAGAGGCTAAGCCAGAAGCTAAACCAGAGGCTAAGTCAGAAGCTAAACCAGAGGCTAAGCTAGAAGCT

AAACCAGAGGCCAAACCAGCAACCAAAAAATCGGTTAATACTAGCGGAAACTTGGCGGCTAAAAAAGCTATT

GAAAACAAAAAGTATAGTAAAAAATTACCATCAACGGGTGAAGCCGCAAGTCCACTCTTAGCAATTGTATCA

CTAATTGTTATGTTAAGTGCAGGTCTTATTACGATAGTTTTAAAGCATAAAAAAAATTAA

ORF amino acid sequence (SEQ ID NO: 179):

MNNNEKKVKYFLRKTAYGLASMSAAFAVCSGIVHADTSSGISASIPHKKQVNLGAVTLKNLISKYRGNDKAI

AILLSRVNDFNRASQDTLPQLINSTEAEIRNILYQGQIGKQNKPSVTTHAKVSDQELGKQSRRSQDIIKSLG

FLSSDQKDILVKYISSSKDSQLILKFVTQATQLNNAESTKAKQMAQNDVALIKNISPEVLEEYKEKIQRAST

KSQVDEFVAEAKKVVNSNKETLVNQANGKKQEIDKLENLSNDEMLRYNTAIDNVVKQYNEGKLNITAAMNAL

NSIKQAAQEVAQKNLQKQYAKKIERISSKGLALSKKAKEIYEKHKSILPTPGYYADSVGTYLNRFRDKQTFG

NRSVWTGQSGLDEAKKMLDEVKKLLKELQDLTRGTKEDKKPDVKPEAKPEAKPNIQVPKQAPTEAAKPALSP

EALTRLTTWYNQAKDLLKDDQVKDKYVDILAVQKAVDQAYDHVEEGKFITTDQANQLANKLRDALQSLELKD

KKVAKPEAKPEAKPEAKPEAKPEAKPEAKPEAKPEAKPDVKPEAKPDVKPEAKPEAKPEAKSEAKPEAKLEA

KPEAKPATKKSVNTSGNLAAKKAIENKKYSKKLPSTGEAASPLLAIVSLIVMLSAGLITIVLKHKKN

TABLE 13

(A and B): Overview over the two runs of sequencing of the six antigens from various GBS strains; SEQ ID NOs of the corresponding proteins are listed.

A

| Strain name | Serotype | gbs0233 | gbs1087 | gbs1309 |
|---|---|---|---|---|
| IC97 (III) | III | SEQ ID NO: 235 | n.d. | n.d. |
| IC98 (II) | II | SEQ ID NO: 236 | SEQ ID NO: 287 | SEQ ID NO: 317 |
| IC105 (IV) | IV | SEQ ID NO: 59 | SEQ ID NO: 71 | SEQ ID NO: 83 |
| IC108 (III) | III | SEQ ID NO: 237 | SEQ ID NO: 288 | n.d. |
| IC216 (Ib) | Ib | SEQ ID NO: 238 | SEQ ID NO: 289 | SEQ ID NO: 318 |
| IC244 (III) | III | SEQ ID NO: 239 | n.d. | SEQ ID NO: 319 |
| IC245 (Ib) | Ib | SEQ ID NO: 240 | SEQ ID NO: 290 | SEQ ID NO: 320 |
| IC246 (III) | III | SEQ ID NO: 241 | SEQ ID NO: 291 | n.d. |
| IC247 (III) | III | SEQ ID NO: 242 | n.d. | SEQ ID NO: 321 |
| IC250 (Ib) | Ib | SEQ ID NO: 243 | SEQ ID NO: 292 | SEQ ID NO: 322 |
| IC251 (V) | V | SEQ ID NO: 244 | n.d. | SEQ ID NO: 323 |
| IC252 (III) | III | SEQ ID NO: 245 | SEQ ID NO: 293 | SEQ ID NO: 324 |
| IC252/2 (III) | III | n.d. | n.d. | n.d. |
| IC253 (III) | III | SEQ ID NO: 246 | SEQ ID NO: 294 | SEQ ID NO: 325 |
| IC254 (II) | II | SEQ ID NO: 247 | n.d. | n.d. |
| IC255 (V) | V | SEQ ID NO: 248 | SEQ ID NO: 295 | SEQ ID NO: 326 |
| IC287 (V) | V | SEQ ID NO: 249 | n.d. | SEQ ID NO: 327 |
| IC288 (Ia) | Ia | SEQ ID NO: 250 | n.d. | SEQ ID NO: 328 |
| IC289 (Ib) | Ib | SEQ ID NO: 251 | SEQ ID NO: 296 | SEQ ID NO: 329 |
| IC290 (III) | III | SEQ ID NO: 252 | SEQ ID NO: 297 | SEQ ID NO: 330 |
| IC291 (V) | V | SEQ ID NO: 253 | SEQ ID NO: 298 | SEQ ID NO: 331 |
| IC304 (V) | V | SEQ ID NO: 254 | SEQ ID NO: 299 | SEQ ID NO: 332 |
| IC305 (II) | II | SEQ ID NO: 255 | SEQ ID NO: 300 | SEQ ID NO: 333 |
| IC306 (Ib) | Ib | SEQ ID NO: 256 | SEQ ID NO: 301 | SEQ ID NO: 334 |
| IC361 (Ib) | Ib | SEQ ID NO: 257 | SEQ ID NO: 302 | SEQ ID NO: 335 |
| IC363 (III) | III | SEQ ID NO: 258 | n.d. | SEQ ID NO: 336 |
| IC364 (III) | III | SEQ ID NO: 259 | SEQ ID NO: 303 | SEQ ID NO: 337 |
| IC365 (Ia) | Ia | SEQ ID NO: 260 | SEQ ID NO: 304 | SEQ ID NO: 338 |
| IC366 (n.t.) | non typeable | SEQ ID NO: 261 | n.d. | SEQ ID NO: 339 |
| IC367 (II) | II | SEQ ID NO: 262 | n.d. | n.d. |
| IC368 (Ia) | Ia | SEQ ID NO: 263 | SEQ ID NO: 305 | SEQ ID NO: 340 |
| IC377 (V) | V | SEQ ID NO: 264 | SEQ ID NO: 306 | SEQ ID NO: 341 |
| IC379 (Ib) | Ib | SEQ ID NO: 265 | SEQ ID NO: 307 | SEQ ID NO: 342 |
| IC432 (Ib) | Ib | SEQ ID NO: 266 | n.d. | SEQ ID NO: 343 |
| IC434 (III) | III | SEQ ID NO: 267 | SEQ ID NO: 308 | n.d. |
| IC455 (III) | III | SEQ ID NO: 268 | n.d. | SEQ ID NO: 344 |
| IC457 (II) | II | SEQ ID NO: 269 | SEQ ID NO: 309 | SEQ ID NO: 345 |
| IC458 (Ia) | Ia | SEQ ID NO: 60 | SEQ ID NO: 72 | SEQ ID NO: 84 |
| IC459 (Ib) | Ib | SEQ ID NO: 270 | n.d. | SEQ ID NO: 346 |
| IC460 (II) | II | SEQ ID NO: 271 | n.d. | SEQ ID NO: 347 |
| IC461 (Ib) | Ib | SEQ ID NO: 272 | SEQ ID NO: 310 | SEQ ID NO: 348 |
| IC462 (II) | II | SEQ ID NO: 273 | n.d. | n.d. |
| IC463 (Ib) | Ib | SEQ ID NO: 274 | n.d. | SEQ ID NO: 349 |
| IC469 (V) | V | SEQ ID NO: 275 | SEQ ID NO: 311 | SEQ ID NO: 350 |
| IC470 (V) | V | SEQ ID NO: 276 | n.d. | n.d. |
| 126H4A (Ia) | Ia | SEQ ID NO: 277 | n.d. | SEQ ID NO: 351 |
| 5095S2 (Ib) | Ib | SEQ ID NO: 278 | n.d. | n.d. |
| 6313 (III) | III | SEQ ID NO: 279 | SEQ ID NO: 230 | SEQ ID NO: 352 |
| 12351 (IV) | IV | SEQ ID NO: 280 | n.d. | SEQ ID NO: 353 |
| NEM316, 12403 (III) | III | SEQ ID NO: 229 | n.d. | SEQ ID NO: 231 |
| 12403/2 (III) | III | SEQ ID NO: 281 | n.d. | SEQ ID NO: 354 |
| 12401 (Ib) | Ib | SEQ ID NO: 56 | SEQ ID NO: 68 | SEQ ID NO: 80 |
| COH1 (III) | III | SEQ ID NO: 58 | SEQ ID NO: 70 | SEQ ID NO: 82 |
| BAA23 (V) | V | SEQ ID NO: 57 | SEQ ID NO: 69 | SEQ ID NO: 81 |
| 0176H4A (II) | II | SEQ ID NO: 55 | SEQ ID NO: 67 | SEQ ID NO: 79 |
| A909 (Ia/c) | Ia/c | SEQ ID NO: 282 | SEQ ID NO: 312 | SEQ ID NO: 355 |
| C388/90 (Ia/c) | Ia/c | SEQ ID NO: 283 | SEQ ID NO: 313 | SEQ ID NO: 356 |
| BAA22 (III) | III | SEQ ID NO: 284 | SEQ ID NO: 314 | SEQ ID NO: 357 |
| 2603V/R (V) | V | SEQ ID NO: 285 | SEQ ID NO: 315 | SEQ ID NO: 358 |
| 49447 (V) | V | SEQ ID NO: 286 | SEQ ID NO: 316 | SEQ ID NO: 359 |
| BAA611 (V) | V | n.d. | n.d. | n.d. |

B

| Strain name | Serotype | gbs1477 | gbs1478 | gbs2018 |
|---|---|---|---|---|
| IC97 (III) | III | SEQ ID NO: 101 | n.d. | SEQ ID NO: 379 |
| IC98 (II) | II | SEQ ID NO: 102 | SEQ ID NO: 187 | SEQ ID NO: 380 |
| IC105 (IV) | IV | SEQ ID NO: 103 | SEQ ID NO: 188 | SEQ ID NO: 178 |
| IC108 (III) | III | n.d. | SEQ ID NO: 189 | n.d. |
| IC216 (Ib) | Ib | SEQ ID NO: 104 | SEQ ID NO: 190 | SEQ ID NO: 381 |

TABLE 13-continued (A and B): Overview over the two runs of sequencing of the six antigens
from various GBS strains; SEQ ID NOs of the corresponding proteins are listed.

| | | | | |
|---|---|---|---|---|
| IC244 (III) | III | n.d. | SEQ ID NO: 191 | SEQ ID NO: 382 |
| IC245 (Ib) | Ib | SEQ ID NO: 105 | SEQ ID NO: 192 | SEQ ID NO: 383 |
| IC246 (III) | III | n.d. | SEQ ID NO: 193 | n.d. |
| IC247 (III) | III | n.d. | SEQ ID NO: 194 | SEQ ID NO: 384 |
| IC250 (Ib) | Ib | SEQ ID NO: 106 | SEQ ID NO: 195 | SEQ ID NO: 385 |
| IC251 (V) | V | SEQ ID NO: 107 | SEQ ID NO: 196 | SEQ ID NO: 386 |
| IC252 (III) | III | SEQ ID NO: 108 | n.d. | SEQ ID NO: 387 |
| IC252/2 (III) | III | SEQ ID NO: 360 | n.d. | n.d. |
| IC253 (III) | III | SEQ ID NO: 109 | SEQ ID NO: 197 | SEQ ID NO: 388 |
| IC254 (II) | II | SEQ ID NO: 110 | n.d. | SEQ ID NO: 389 |
| IC255 (V) | V | SEQ ID NO: 111 | n.d. | SEQ ID NO: 390 |
| IC287 (V) | V | SEQ ID NO: 112 | n.d. | SEQ ID NO: 391 |
| IC288 (Ia) | Ia | n.d. | n.d. | n.d. |
| IC289 (Ib) | Ib | SEQ ID NO: 113 | SEQ ID NO: 198 | SEQ ID NO: 392 |
| IC290 (III) | III | n.d. | n.d. | SEQ ID NO: 393 |
| IC291 (V) | V | SEQ ID NO: 114 | SEQ ID NO: 199 | SEQ ID NO: 394 |
| IC304 (V) | V | SEQ ID NO: 115 | SEQ ID NO: 200 | SEQ ID NO: 395 |
| IC305 (II) | II | SEQ ID NO: 116 | SEQ ID NO: 201 | SEQ ID NO: 396 |
| IC306 (Ib) | Ib | SEQ ID NO: 117 | SEQ ID NO: 202 | SEQ ID NO: 397 |
| IC361 (Ib) | Ib | SEQ ID NO: 118 | n.d. | SEQ ID NO: 398 |
| IC363 (III) | III | SEQ ID NO: 119 | n.d. | SEQ ID NO: 399 |
| IC364 (III) | III | n.d. | n.d. | n.d. |
| IC365 (Ia) | Ia | SEQ ID NO: 120 | SEQ ID NO: 363 | SEQ ID NO: 400 |
| IC366 (n.t.) | non typeable | n.d. | SEQ ID NO: 364 | SEQ ID NO: 401 |
| IC367 (II) | II | SEQ ID NO: 121 | SEQ ID NO: 365 | SEQ ID NO: 402 |
| IC368 (Ia) | Ia | n.d. | n.d. | SEQ ID NO: 403 |
| IC377 (V) | V | SEQ ID NO: 122 | SEQ ID NO: 366 | SEQ ID NO: 404 |
| IC379 (Ib) | Ib | SEQ ID NO: 123 | SEQ ID NO: 367 | SEQ ID NO: 405 |
| IC432 (Ib) | Ib | SEQ ID NO: 124 | SEQ ID NO: 368 | SEQ ID NO: 406 |
| IC434 (III) | III | n.d. | n.d. | n.d. |
| IC455 (III) | III | SEQ ID NO: 125 | SEQ ID NO: 369 | SEQ ID NO: 407 |
| IC457 (II) | II | SEQ ID NO: 126 | SEQ ID NO: 370 | SEQ ID NO: 408 |
| IC458 (Ia) | Ia | SEQ ID NO: 127 | SEQ ID NO: 203 | SEQ ID NO: 179 |
| IC459 (Ib) | Ib | SEQ ID NO: 128 | SEQ ID NO: 371 | SEQ ID NO: 409 |
| IC460 (II) | II | SEQ ID NO: 129 | SEQ ID NO: 372 | SEQ ID NO: 410 |
| IC461 (Ib) | Ib | SEQ ID NO: 130 | SEQ ID NO: 373 | SEQ ID NO: 411 |
| IC462 (II) | II | SEQ ID NO: 131 | SEQ ID NO: 374 | SEQ ID NO: 412 |
| IC463 (Ib) | Ib | n.d. | n.d. | SEQ ID NO: 413 |
| IC469 (V) | V | n.d. | SEQ ID NO: 375 | SEQ ID NO: 414 |
| IC470 (V) | V | SEQ ID NO: 132 | SEQ ID NO: 376 | SEQ ID NO: 415 |
| 126H4A (Ia) | Ia | SEQ ID NO: 94 | n.d. | SEQ ID NO: 416 |
| 5095S2 (Ib) | Ib | SEQ ID NO: 96 | n.d. | SEQ ID NO: 417 |
| 6313 (III) | III | SEQ ID NO: 97, SEQ ID NO: 232 | SEQ ID NO: 233 | SEQ ID NO: 418 |
| T2351 (IV) | IV | SEQ ID NO: 92 | n.d. | SEQ ID NO: 419 |
| NEM316, 12403 (III) | III | n.d. | n.d. | SEQ ID NO: 234 |
| 12403/2 (III) | III | SEQ ID NO: 361 | n.d. | SEQ ID NO: 420 |
| 12401 (Ib) | Ib | SEQ ID NO: 93 | SEQ ID NO: 185 | SEQ ID NO: 176 |
| COH1 (III) | III | n.d. | n.d. | SEQ ID NO: 421 |
| BAA23 (V) | V | SEQ ID NO: 98 | SEQ ID NO: 186 | SEQ ID NO: 177 |
| 0176H4A (II) | II | SEQ ID NO: 91 | SEQ ID NO: 377 | SEQ ID NO: 175 |
| A909 (Ia/c) | Ia/c | n.d. | n.d. | n.d. |
| C388/90 (Ia/c) | Ia/c | SEQ ID NO: 100 | n.d. | SEQ ID NO: 422 |
| BAA22 (III) | III | n.d. | n.d. | SEQ ID NO: 423 |
| 2603V/R (V) | V | SEQ ID NO: 362 | SEQ ID NO: 378 | SEQ ID NO: 424 |
| 49447 (V) | V | SEQ ID NO: 95 | n.d. | SEQ ID NO: 425 |
| BAA611 (V) | V | SEQ ID NO: 99 | n.d. | n.d. |

SEQUENCE LISTING (425 sequences)

SEQ ID NO: 1 - protein, 295 aa, Streptococcus agalactiae
LCLALLTISGCQLTDTKKPGHTTIKVAAQSSTESSIMANIVTELIHHELGYNTTLISNLGSSTVTHQALLRGDADIAATRYTGTDITGTLGLKAVKDTKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGD

SEQ ID NO: 2 - protein, 319 aa, Streptococcus agalactiae
MDSVGNQSQGNVLERRQRDAENRSQGNVLERRQRDVENKSQGNVLERRQRDAENKSQGNVLERRQRDAENRSQGNVLERRQRDAENRSQGNVLERRQRDAENRSQGNVLERRQRDAENRSQGNVLERRQRDAENRSQGNVLERRQRDVENKSQGNVLERRQRDAENKSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENKSQVGQLIG

SEQ ID NO: 3 - protein, 400 aa, Streptococcus agalactiae
SVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIK

SEQ ID NO: 4 - protein, 619 aa, Streptococcus agalactiae
DDVTTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDTGFAFNTAKLKGTYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVTIPQTGGIGT

SEQ ID NO: 5 - protein, 836 aa, Streptococcus agalactiae
ESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNHEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPRAKWGSTTNGLTPEQQKQYYLSKVGETFTMKAFMEADDILSQVDRNSQKIIVHITDGVPTRSYAINNFKLGASYESQFEQMKKNGYLNKSNFLLTDKPEDIKGNGESYFLFPLDSYQTQIISGNLQKLHYLDLNLNYPKGTIYRNGPVREHGTPTKLYINSLKQKNYDIFNFGIDISAFRQVYNEDYKKNQDGTFQKLKEEAFELSDGEITELMKSFSSKPEYYTPIVTSSDASNNEILSKIQQQFEKVLTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGK

SEQ ID NO: 6 - protein, 577 aa, Streptococcus agalactiae
DTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPST

SEQ ID NO: 7 - DNA, 885 bp, Streptococcus agalactiae
ctttgcttagccctcttaacgatttctggttgtcaattaaccgatactaaaaaacctggtcataccacaattaaggttgctgcccaaagttctacagagtctagtatcatggcaaatattgtcaccgaattaattcatcacgaattaggatacaacacaactttaataagcaatcttggttcctctacggttactcaccaagctttgctccgtggtgatgctgacattgctgccacacgttatacaggaacagacatcacaggaactcttggcttaaaagctgttaaagacactaaagaagcttctaagattgtaaaaactgaattccaaaaacgctacaatcaaacttggtatcctacttatggtttttctgatacttatgcattcatggttactaaagagtttgccagacagaataaaatcaccaagatctctgatctcaaaaagttatcaacaactatgaaggcaggggttgatagttcatggatgaatcgcgagggagatggatacactgatttcgctaaaacatacggttttgaattttcacatatttaccctatgcaaattggcttagtctatgatgcagttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagat

SEQ ID NO: 8 - DNA, 957 bp, Streptococcus agalactiae
atggatagtgttggaaatcaaagtcagggcaatgttttagagcgtcgtcaacgtgatgcagaaaacagaagccaaggcaatgttctagagcgtcgtcaacgcgatgttgagaataagagccaaggcaatgttttagagcgtcgtcaacgtgatgcggaaaacaagagccaaggcaatgttttagagcgtcgtcaacgtgatgcagaaaacagaagccaaggcaatgttctagagcgtcgtcaacgtgatgcagaaaacagaagccaaggcaatgttctagagcgtcgtcaacgcgatgcagaaaacagaagccaaggtaatgttctagagcgtcgtcaacgtgatgcagaaaacagaagccaaggtaatgttctagagcgtcgtcaacgtgatgcagaaaacagaagccaaggtaatgttctagagcgtcgtcaacgcgatgttgagaataagagccaaggcaatgttttagagcgtcgtcaacgtgatgcggaaaacaagagccaaggcaatgttttagagcgtcgtcaacgtgatgcagaaaacagaagccaaggcaatgttttagagcgtcgtcaacgtgatgcagaaaacagaagccaaggcaatgttctagagcgtcgtcaacgtgatgcagaaaacagaagccaaggcaatgttctagagcgtcgtcaacgtgatgcagaaaacagaagccaaggcaatgttctagagcgtcgtcaacgcgatgcagaaaacagaagccaaggtaatgttctagagcgtcgtcaacgtgatgcagaaaacagaagccaaggcaatgttttagagcgtcgtcaacgtgatgcagaaaacagaagccaaggcaatgttttagagcgtcgtcaacgtgatgcagaaaacagaagccaaggcaatgttttagagcgtcgtcaacgtgatgcggaaaacaagagccaagtaggtcaacttataggg

SEQ ID NO: 9 - DNA, 1200 bp, Streptococcus agalactiae
agtgtaacctattcacagtctgaacgtacggttgttttctcttttggagaaataacatttagtaggagtcgctggacaaatggctttgaaactagaataccagtagatgagtggttaggtcttgaaaaatataagagatattcaatagaattcttatatcatgttgcaaaattggctacaatgatgccttatcgtcaagtttgcaaagtaatagatagcactttgcaaacaatcataacaaaagactgtgttttaaaagcagtaaaatttgtagaaaaattgttaaaagaaaaagaacgctatcgtttttatttggaagagccacccgaacgtaaaaaagtgaaaaaactgtatgttgagggtgatggagtcatgattaaaagcacagattctagagaggaaagaaggtatttagatttaacacattttgttattcatacaggctcaaaaaaagtttctactaaaagatatgaattgcaggacaagcacgaaatattacagcttaattatgataaagctaaatataatcttttagattatatttataataactatgaagtagatgacgatactattttaatcactaactctgatatgggtaaaggctatactagtagagtttttaaggaattaggaaaagcacttaaggtaaagaaacatgagcatttttgggatatctatcatgttaaagaaaagttaagttcataccttagaaaatatccaattgaattaaccgattttgctttagatgcggtaaaaaaatataattctgataagcttgaattagtttttgatactgttgaatcactgatttgtgatgaacttgaagatcaagaatttcagaagtttaagaaaaaagtattaaataatttcaaatatataaaaccagctcatcttagaaatctttcaaatcgtggtattggtatcatggaatcacaacacagaaagataacgtatagaatgaagcgacgtggcatgtattggtcaaagtggggaatctccacaatggcaaatatgattatacttgaaagagctaacggtttacgagaattatttttcggttcttggagaaaggtatacagtgagtataaagaaggttcatttagtgcagggcgactttttaaaaagacagatgaattagataaattttctaagccccttctaaaaaatggcagaaaatggagtataacaggaatcaaa

SEQ ID NO: 10 - DNA, 1857 bp, Streptococcus agalactiae
gacgacgtaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaattaagggtgctttctttgttttcaaaaatgaaactggtacaaaattcattactgaaaatggtaaggaagtcgatactttggaagctaaagatgctgaaggtggtgctgttctttcagggttaacaaaagacactggttttgcttttaacactgctaagttaaaaggaacttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaaccatcccacaaacaggtggtattggtaca

SEQ ID NO: 11 - DNA, 2508 bp, Streptococcus agalactiae
gaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgagctaacaggtgaagctacttttgataatctcatacctggagattatactttatcagaagaaacagcgcccgaaggttataaaaagactaaccagacttggcaagttaaggttgagagtaatggaaaaactacgatacaaaatagtggtgataaaaattccacaattggacaaaatcacgaagaactagataagcagtatccccccacaggaatttatgaagatacaaaggaatcttataaacttgagcatgttaaaggttcagttccaaatggaaagtcagaggcaaaagcagttaacccatattcaagtgaaggtgagcatataagagaaattccagagggaacattatctaaacgtatttcagaagtaggtgatttagctcataataaatataaaattgagttaactgtcagtggaaaaaccatagtaaaaccagtggacaaacaaaagccgttagatgttgtcttcgtactcgataattctaactcaatgaataacgatggcccaaattttcaaaggcataataaagccaagaaagctgccgaagctcttgggaccgcagtaaaagatattttaggagcaaacagtgataatagggttgcattagttacctatggttcagatatttttgatggtaggagtgtagatgtcgtaaaaggatttaaagaagatgataaatattatggccttcaaactaagttcacaattcagacagagaattatagtcataaacaattaacaaataatgctgaagagattataaaaaggattcctacagaagctcctagagctaaatggggatcaactacaaacggacttactccagagcaacaaaagcagtactatcttagtaaagtaggggaaacatttactatgaaagccttcatggaggcagatgatattttgagtcaagtagatcgaaatagtcaaaaaattattgttcatataactgatggtgttccaacaagatcatatgctattaataattttaaattgggtgcatcatatgaaagccaatttgaacaaatgaaaaaaaatggatatctaaataaaagtaattttctacttactgataagcccgaggatataaaaggaaatggggagagttactttttgtttcccttagatagttatcaaacacagataatctctggaaacttacaaaaacttcattatttagatttaaatcttaattaccctaaaggtacaatttatcgaaatggaccagtaagagaacatggaacaccaaccaaactttatataaatagtttaaaacagaaaaattatgacatctttaattttggtatagatatatctgcttttagacaagtttataatgaggattataagaaaaatcaagatggtacttttcaaaaattgaaagaggaagcttttgaactttcagatggggaaataacagaactaatgaagtcattctcttctaaacctgagtattataccccgatagtaacttcatccgatgcatctaacaatgaaattttatctaaaattcagcaacaatttgaaaaggttttaacaaaagaaaactcaattgttaatggaactatagaagatcctatgggtgacaaaatcaatttacagcttggcaacggacaaacattgcaaccaagtgattatactttacagggaaatgatggaagtataatgaaagatagcattgcaactggtgggcctaataatgatggtggaatacttaaaggggttaaattagaatacatcaaaaataaactctacgttagaggtttgaacttaggggagggacaaaaagtaacactcacatatgatgtgaaactagatgacagttttataagtaacaaattctatgacactaatggtagaacaacattgaatcctaaatcagaggatcctaatacacttagagattttccaatccctaaaattcgtgatgtgagagaatatcctacaataacgattaaaaacgagaagaagttaggtgaaattgaatttacaaaagttgataaagataataataagttgcttctcaaaggagctacgtttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccgaaggattatcaaaaaattactaataaaccaattttaacttttgaagttgttaaaggatcgatacaaaatataatagctgttaataaacagatttctgaatatcatgaggaaggtgacaagcatttaattaccaacacgcatattccaccaaaaggaattattccgatgacaggtgggaaa

SEQ ID NO: 12 - DNA, 1731 bp, Streptococcus agalactiae
gatactagttcaggaatatcggcttcaattcctcataagaaacaagttaatttaggggcggttactctgaagaatttgatttctaaatatcgtggtaatgacaaagctattgctatacttttaagtagagtaaatgattttaatagagcatcacaggatacacttccacaattaattaatagtactgaagcagaaattagaaatattttatatcaaggacaaattggtaagcaaaataaaccaagtgtaactacacatgctaaagttagtgatcaagaactaggtaagcagtcaagacgttctcaagatatcattaagtcattaggtttcctttcatcagaccaaaaagatattttagttaaatctattagctcttcaaaagattcgcaacttattcttaaatttgtaactcaagccacgcaactgaataatgctgaatcaacaaaagctaagcaaatggctcaaaatgacgtggccttaataaaaaatataagccccgaagtcttagaagaatataaagaaaaaattcaaagagctagcactaagagtcaagttgatgagtttgtagcagaagctaaaaaagttgttaattccaataaagaaacgttggtaaatcaggccaatggtaaaaagcaagaaattgctaagttagaaaatttatctaacgatgaaatgttgagatataatactgcaattgataatgtagtgaaacagtataatgaaggtaagctcaatattactgctgcaatgaatgctttaaatagtattaagcaagcagcacaggaagttgcccagaaaaacttacaaaagcagtatgctaaaaaaattgaaagaataagttcaaaaggattagcgttatctaaaaaggctaaagaaatttatgaaaagcataaaagtattttgcctacacctggatattatgcagactctgtgggaacttatttgaataggtttagagataaacaaactttcggaaataggagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccaaatattcaagtacctaaacaagcacctacagaagctgcaaaaccagctttgtcaccagaagccttgacaagattgactacatggtataatcaagctaaagatctgcttaaagatgatcaagtaaaggacaaatacgtagatatacttgcagttcaaaaagctgttgaccaagcttatgatcatgtggaagagggaaaatttattaccactgatcaagcaaatcaattagctaacaagctacgtgatgctttacaaagtttagaattaaaagataaaaaagtagccaaaccagaagccaaaccagaggccaaaccagaagctaagccagaagctaagccagaagctaagccagaagctaagccagaggccaaaccagaagctaagccagacgttaagccagaagctaaaccagacgttaaaccagaggctaagccagaagctaaaccagaggctaagtcagaagctaaaccagaggctaagctagaagctaaaccagaggccaaaccagcaaccaaaaaatcggttaatactagcggaaacttggcggctaaaaaagctattgaaaacaaaaagtatagtaaaaaattaccatcaacg

SEQ ID NO: 13 - DNA, 20 bp, Artificial Sequence
  Primer gbs0233 1
gggggcacaattcctgttat

SEQ ID NO: 14 - DNA, 24 bp, Artificial Sequence
  Primer gbs0233 2
aaaaagtggtggataaattgttct

SEQ ID NO: 15 - DNA, 26 bp, Artificial Sequence
  Primer gbs1087 1
cattgtaaatcttaatgttagtatga

SEQ ID NO: 16 - DNA, 24 bp, Artificial Sequence
  Primer gbs1087 2
tgactttgatttccaacactatcc

SEQ ID NO: 17 - DNA, 24 bp, Artificial Sequence
  Primer gbs1087 3
ggttttagaacttggaaatcagga

SEQ ID NO: 18 - DNA, 26 bp, Artificial Sequence
  Primer gbs1087 4
ggtctattagctacattagtaacctg

SEQ ID NO: 19 - DNA, 26 bp, Artificial Sequence
  Primer gbs1087 5
agagaaaataatcactctagtcaagg

SEQ ID NO: 20 - DNA, 21 bp, Artificial Sequence
  Primer gbs1087 6
aaaaagtcaccctaaccaacc

SEQ ID NO: 21 - DNA, 20 bp, Artificial Sequence
  Primer gbs1309 1
aatcatcggtgaagtgacga

SEQ ID NO: 22 - DNA, 25 bp, Artificial Sequence
  Primer gbs1309 2
cggttaattcaattggatattttct

SEQ ID NO: 23 - DNA, 23 bp, Artificial Sequence
  Primer gbs1309 3
actctgatatgggtaaaggctat

SEQ ID NO: 24 - DNA, 27 bp, Artificial Sequence
  Primer gbs1309 4
cttgaattattcttaaaaagaccaaaa

SEQ ID NO: 25 - DNA, 25 bp, Artificial Sequence
  Primer gbs1309 5
ccagtagatgagtggttaggtcttg

SEQ ID NO: 26 - DNA, 25 bp, Artificial Sequence
  Primer gbs1309 6
aagatgagctggttttatatatttg

SEQ ID NO: 27 - DNA, 23 bp, Artificial Sequence
  Primer gbs1477 1
ttgcaggtggaatttatatttgg

SEQ ID NO: 28 - DNA, 27 bp, Artificial Sequence
  Primer gbs1477 2
ttcttatctacttgtggttttgtttca

SEQ ID NO: 29 - DNA, 20 bp, Artificial Sequence
  Primer gbs1477 3
tcttggctgattcaaaagca

SEQ ID NO: 30 - DNA, 20 bp, Artificial Sequence
  Primer gbs1477 4
ggttctgatgggttgattgg

SEQ ID NO: 31 - DNA, 21 bp, Artificial Sequence
  Primer gbs1477 5
aatggctcttgcttatgatct

SEQ ID NO: 32 - DNA, 20 bp, Artificial Sequence
  Primer gbs1477 6
tgttagcggctacactccag

SEQ ID NO: 33 - DNA, 23 bp, Artificial Sequence
  Primer gbs1477 7
ttgcaggtggaatttatatttgg

SEQ ID NO: 34 - DNA, 19 bp, Artificial Sequence
  Primer gbs1477 8
caacttttggttcagttgg

SEQ ID NO: 35 - DNA, 18 bp, Artificial Sequence
  Primer gbs1477 9
cccattgtcaaaccattt

SEQ ID NO: 36 - DNA, 20 bp, Artificial Sequence
  Primer gbs1477 10
gctactgctgaaatcggtma

SEQ ID NO: 37 - DNA, 20 bp, Artificial Sequence
  Primer gbs1477 11
catacatgatctcagaacgt

SEQ ID NO: 38 - DNA, 21 bp, Artificial Sequence
  Primer gbs1477 12
aatggctcttgcttatgatct

SEQ ID NO: 39 - DNA, 27 bp, Artificial Sequence
  Primer gbs1478 1
tctaggatattctgtatctgatcttag

SEQ ID NO: 40 - DNA, 21 bp, Artificial Sequence
  Primer gbs1478 2
ccatcaaaaatatctgaacca

SEQ ID NO: 41 - DNA, 27 bp, Artificial Sequence
  Primer gbs1478 3
gagggaacattatctaaacgtatttca

SEQ ID NO: 42 - DNA, 26 bp, Artificial Sequence
  Primer gbs1478 4
ttcaatttttgaaaagtaccatcttg

SEQ ID NO: 43 - DNA, 20 bp, Artificial Sequence
  Primer gbs1478 5
gaacatggaacaccaaccaa

SEQ ID NO: 44 - DNA, 24 bp, Artificial Sequence
  Primer gbs1478 6
tcaatttcacctaacttcttctcg

SEQ ID NO: 45 - DNA, 21 bp, Artificial Sequence
  Primer gbs1478 7
ttttccaatccctaaaattcg

SEQ ID NO: 46 - DNA, 26 bp, Artificial Sequence
  Primer gbs1478 8
ttttcatttctatctccttcttattc

SEQ ID NO: 47 - DNA, 22 bp, Artificial Sequence
  Primer gbs2018 1
aaaaggcaaagttctgatgagg

SEQ ID NO: 48 - DNA, 23 bp, Artificial Sequence
  Primer gbs2018 2
aaaaatgcttgatgaagtcaaaa

SEQ ID NO: 49 - DNA, 20 bp, Artificial Sequence
  Primer gbs2018 3
gtttggcttctggcttaacg

SEQ ID NO: 50 - DNA, 25 bp, Artificial Sequence
  Primer gbs2018 4
tgatcaagaactaggtaagcagtca

SEQ ID NO: 51 - DNA, 25 bp, Artificial Sequence
  Primer gbs2018 5
caaatttaagaataagttgcgaatc

SEQ ID NO: 52 - DNA, 27 bp, Artificial Sequence
  Primer gbs2018 6
agagtaaatgattttaatagagcatca

SEQ ID NO: 53 - DNA, 26 bp, Artificial Sequence
  Primer gbs2018 7
aaaatatttctaatttctgcttcagt

SEQ ID NO: 54 - DNA, 25 bp, Artificial Sequence
  Primer gbs2018 8
aattaaaataaacgtggtcctatcc

SEQ ID NO: 55 - protein, 308 aa, Streptococcus agalactiae
MLKKSHFLQIFTLCLALLTISGCQLTDTKKPGHTTIKVAAQSSTESSIMANIVTELIHHELGYNTTLISNLGSSTVTHQALLRGDADIAATRYTGTDITGTLGLKAVKDPKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 56 - protein, 308 aa, Streptococcus agalactiae
MLKKSHFLQIFTLCLALLTISGCQLTDTKKSGHTTIKVAAQSSTESSIMANIITELIHHELGYNTTLISNLGSSTVTHQALLRGDADIAATRYTGTDITGTLGLKAVKDPKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 57 - protein, 308 aa, Streptococcus agalactiae; identical to SEQ ID NO: 56

SEQ ID NO: 58 - protein, 308 aa, Streptococcus agalactiae; identical to SEQ ID NO: 55

SEQ ID NO: 59 - protein, 308 aa, Streptococcus agalactiae; identical to SEQ ID NO: 56

SEQ ID NO: 60 - protein, 308 aa, Streptococcus agalactiae
MLKKSHFLQIFTLCLALLTISGCQLTDTKKPGHTTIKVAAQSSTESSIMANIVTELIHHELGYNTTLISNLGSSTVTHQALLRGDADIAATRYTGTDITGTLGLKAVKDTKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 61 - DNA, 927 bp, Streptococcus agalactiae
atgcttaaaaaatcgcactttttacagatatttacactttgcttagccctcttaacgatttctggttgtcaattaaccgatactaaaaaacctggtcataccacaattaaggttgctgcacaaagttctacagagtctagtatcatggcaaatattgtcaccgaattaattcatcacgaattaggatacaacacaactttaataagcaatcttggttcctctacggttactcaccaagctttgctccgtggtgatgctgacattgctgccacacgttatacaggaacagacatcacaggaactcttggcttaaaagctgttaaagaccctaaagaagcttctaagattgtaaaaactgaattccaaaaacgctacaatcaaacttggtatcctacttatggtttttctgatacttatgcattcatggttactaaagagtttgccagacagaataaaatcaccaagatctctgatctcaaaaaattatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaataa

SEQ ID NO: 62 - DNA, 927 bp, Streptococcus agalactiae
atgcttaaaaaatcgcactttttacagatatttacactttgcttagccctcttaacgatttctggttgtcaattaaccgatactaaaaagtctggtcataccacaattaaggttgctgcccaaagttctacagagtctagtattatggcaaatattatcaccgaattaattcatcacgaattaggatacaacacaactttaataagcaatcttggttcctctacggttactcaccaagctttgctccgtggtgatgctgacattgctgccacacgttatacaggaacagacatcacagggactcttggtttaaaagctgttaaagaccctaaagaagcttctaagattgtaaaaactgaattccaaaaacgctacaatcaaacttggtatcctacttatggtttttctgatacttatgcattcatggttactaaagagtttgccagacagaataaaatcactaagatctctgatcttaaaaaattatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaataa

SEQ ID NO: 63 - DNA, 927 bp, Streptococcus agalactiae; identical to SEQ ID NO: 62

SEQ ID NO: 64 - DNA, 927 bp, Streptococcus agalactiae
atgcttaaaaaatcgcactttttacagatatttacactttgcttagccctcttaacgatttctggttgtcaattaaccgatactaaaaaacctggtcataccacaattaaggttgctgcccaaagttctacagagtctagtatcatggcaaatattgtcaccgaattaattcatcacgaattaggatacaacacaactttaataagcaatcttggttcctctacggttactcaccaagctttgctccgtggtgatgctgacattgctgccacacgttatacaggaacagacatcacaggaactcttggcttaaaagctgttaaagaccctaaagaagcttctaagattgtaaaaactgaattccaaaaacgctacaatcaaacttggtatcctacttatggtttttctgatacttatgcattcatggttactaaagagtttgccagacagaataaaatcaccaagatctctgatctcaaaaagttatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaataa

SEQ ID NO: 65 - DNA, 927 bp, Streptococcus agalactiae; identical to SEQ ID NO: 62

SEQ ID NO: 66 - DNA, 927 bp, Streptococcus agalactiae
atgcttaaaaaatcgcactttttacagatatttacactttgcttagccctcttaacgatttctggttgtcaattaaccgatactaaaaaacctggtcataccacaattaaggttgctgcccaaagttctacagagtctagtatcatggcaaatattgtcaccgaattaattcatcacgaattaggatacaacacaactttaataagcaatcttggttcctctacggttactcaccaagctttgctccgtggtgatgctgacattgctgccacacgttatacaggaacagacatcacaggaactcttggcttaaaagctgttaaagacactaaagaagcttctaagattgtaaaaactgaattccaaaaacgctacaatcaaacttggtatcctacttatggtttttctgatacttatgcattcatggttactaaagagtttgccagacagaataaaatcaccaagatctctgatctcaaaaagttatcaacaactatgaaggcaggggttgatagttcatggatgaatcgcgagggagatggatacactgatttcgctaaaacatacggttttgaattttcacatatttaccctatgcaaattggcttagtctatgatgcagttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagaggagataaataa

SEQ ID NO: 67 - protein, 186 aa, Streptococcus agalactiae
LFNKIGFRTWKSGKLWLYMGVLGSTIILGSSPVSAMDSVGNQSQGNVLERRQRDAENRSQGNVLERRQRDAENRSQGNVLERRQRDAENKSQVGQLIGKNPLLSKSIISRENNHSSQGDSNKQSFSKKVSQVTNVANRPMLTNNSRTISVINKLPKTGDDQNVIFKLVGFGLILLTSRCGLRRNEN

SEQ ID NO: 68 - protein, 250 aa, Streptococcus agalactiae
LFNKIGFRTWKSGKLWLYMGVLGSTIILGSSPVSAMDSVGNQSQGNVLERRQRDADNKSQGNVLERRQRDVENKSQGNVLERRQRDVENKSQGNVLERRQRDAENKSQGNVLERRQRDADNKSQGNVLERRQRDVENKSQGNVLERRQRDVENKSQVGQLIGKNPLLSKSTISRENNHSSQGDSNKQSFSKKVSQVTNVANRPMLTNNSRTISVINKLPKTGDDQNVIFKLVGFGLILLTSRCGLRRNEN

SEQ ID NO: 69 - protein, 394 aa, Streptococcus agalactiae
LFNKIGFRTWKSGKLWLYMGVLGSTIILGSSPVSAMDSVGNQSQGNVLERRQRDAENRSQGNVLERRQRDAENRSQGNVLERRQRDAENRSQGNVLERRQRDVENKSQGNVLERRQRDVENKSQGNVLERRQRDAENKSQGNVLERRQRDAENKSQGNVLERRQRDAENRSQGNVLERRQRDVENKSQGNVLERRQRDVENKSQGNVLERRQRDADNKSQGNVLERRQRDVENKSQGNVLERRQNNVLIKSQDNVLERRQRDADNKSQGNVLERRQRDVENKSQGNVLERRQHDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 70 - protein, 218 aa, Streptococcus agalactiae
LFNKIGFRTWKSGKLWLYMGVLGSTIILGSSPVSAMDSVGNQSQGNVLERRQRDAENKSQGNVLERRQRDAENKSQGNVLERRQRDVENKSQGNVLERRQRDAENKSQGNVLERRQRDADNKSQVGQLIGKNPLFSKPTVSRENNHSSQGDSNKQSFSKKVSQVTNVANRPMLTNNSRTISVINKLPKTGGDQNVIFKLVGFGLILLTSRCGLRRNEN

SEQ ID NO: 71 - protein, 442 aa, Streptococcus agalactiae
LFNKIGFRTWKSGKLWLYMGVLGSTIILGSSPVSAMDSDGNQSQGNVLERRQRDAENKSQGNVLERRQRDAENRSQGNDLERRQRDVENKSQGNVLERRQRDADNKSQGNVLERRQRDVENKSQGNVLERRQNNVLIKSQDNDLERRQRDADNKSQGNVLERRQRDVENKSQGNVLERRQRDADNKSQGNVLECRQRDVENKSQGNVLERRQRDAENKSQGNVLERRQRDAENRSQGNVLERRQRDVENKSQGNVLERRQRDADNKSQGNVLERRQRDVENKSQGNVLERRQNNVLIKSQDNVLERRQRDADNKSQGNVLERRQRDVENKSQGNVLERRQRDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 72 - protein, 330 aa, Streptococcus agalactiae
LFNKIGFRTWKSGKLWLYMGVLGSTIILGSSPVSAMDSVGNQSQGNVLERRQRDVENKSQGNVLERRQRDAENKSQGNVLERRQRDAENRSQGNVLERRQRDAENRSQGNVLERRQRDVENKSQGNVLERRQRDVENKSQGNVLERRQRDAENKSQGNVLERRQRDAENRSQGNVLERRQRDAENRSQGNVLERRQRDVENKSQGNVLERRQRDAENRSQGNVLERRQRDAENRSQVGQLIGKNPLLSKSIISRENNHSSQGDSNKQSFSKKVSQVTNVANRPMLTNNSRTISVINKLPKTGDDQNVIFKLVGFGLILLTSRCGLRRNEN

SEQ ID NO: 73 - DNA, 561 bp, Streptococcus agalactiae
ttgttcaataaaataggttttagaacttggaaatcaggaaagctttggctttatatgggagtgctaggatcaactattattttaggatcaagtcctgtatctgctatggatagtgttggaaatcaaagtcagggcaatgttttagagcgtcgtcaacgcgatgcagaaaacagaagccaaggtaatgttctagagcgtcgtcaacgcgatgcagaaaacagaagccaaggtaatgttctagagcgtcgtcaacgtgatgcggaaaacaagagccaagtaggtcaacttatagggaaaaatccacttctttcaaagtcaattatatctagagaaaataatcactctagtcaaggtgactctaacaaacagtcattctctaaaaaagtatctcaggttactaatgtagctaatagaccgatgttaactaataattctagaacaatttcagtgataaataaattacctaaaacaggtgatgatcaaaatgtcatttttaaacttgtaggttttggtttaattttgttaacaagtcgctgcggtttgagacgcaatgaaaattaa

SEQ ID NO: 74 - DNA, 753 bp, Streptococcus agalactiae
ttgttcaataaaataggttttagaacttggaaatcaggaaagctttggctttatatgggagtgctaggatcaactattattttaggatcaagtcctgtatctgctatggatagtgttggaaatcaaagtcaaggtaatgttctagagcgtcgtcaacgtgatgcggataacaagagccaaggtaatgttctagaacgtcgtcaacgcgatgtggaaaacaaaagtcagggcaatgttctagaacgtcgtcaacgtgatgttgagaataagagccaaggcaatgttctagagcgtcgccaacgtgatgcagaaaacaaaagtcagggtaatgttctagagcgtcgtcaacgcgatgcagataacaagagccaaggtaatgttctagaacgtcgtcaacgcgatgtggaaaacaaaagtcagggcaatgttctagagcgtcgccaacgtgatgttgagaacaagagccaagtaggtcaacttatagggaaaaatccacttctttcaaagtcaactatatctagagaaaataatcactctagtcaaggtgactctaacaaacagtcattctctaaaaaagtatctcaggttactaatgtagctaatagaccaatgttaactaataattctagaacaatttcagtgataaataaattacctaaaacaggtgatgatcaaaatgtcatttttaaacttgtaggttttggtttaattttgttaacaagtcgctgcggtttgagacgcaatgaaaattaa

SEQ ID NO: 75 - DNA, 1185 bp, Streptococcus agalactiae
ttgttcaataaaataggttttagaacttggaaatcaggaaagctttggctttatatgggagtgctaggatcaactattattttaggatcaagtcctgtatctgctatggatagtgttggaaatcaaagtcagggcaatgttttagagcgtcgtcaacgtgatgcagaaaacagaagccaaggtaatgttctagagcgtcgtcaacgtgatgcagaaaacagaagccaaggtaatgttctagagcgtcgtcaacgcgatgcagaaaacagaagccaaggtaatgttctagagcgtcgtcaacgtgatgttgagaataagagccaaggcaatgttttagagcgtcgtcaacgcgatgttgagaataagagccaaggtaatgttctagagcgtcgtcaacgtgatgcggaaaacaagagccaaggcaatgttctagagcgtcgtcaacgtgatgcggaaaacaagagccaaggcaatgttctagagcgtcgtcaacgcgatgcagaaaacagaagccaaggtaatgttttagaacgtcgtcaacgcgatgttgagaacaagagccaaggtaacgttctagagcgtcgccaacgtgacgttgagaacaagagccaaggtaatgttttagagcgtcgccaacgcgatgcggataacaaaagtcagggcaatgttttagagcgtcgccaacgtgatgttgagaacaagagccaaggtaatgttctagagcgtcgccaaaataatgtccttattaagagtcaagataatgttctagagcgccgccaacgtgatgcggataacaagagccagggtaacgttctagagcgtcgtcaacgcgatgttgagaataagagccaaggtaatgttttagagcgtcgccaacatgatgttgagaataagagtcaagtaggtcaacttatagggaaaaatccacttttttcaaagtcaactgtatctagagaaaataatcactctagtcaaggtgactctaacaaacagtcattctctaaaaaagtatctcaggttactaatgtagctaatagaccgatgttaactaataattctagaacaatttcagtgataaataaattacctaaaacaggtgatgatcaaaatgtcatttttaaacttgtaggttttggtttaattttattaacaagtctctgcggtttgagacgcaatgaaaattaa

SEQ ID NO: 76 - DNA, 657 bp, Streptococcus agalactiae
ttgttcaataaaataggttttagaacttggaaatcaggaaagctttggctttatatgggagtgctaggatcaactattattttaggatcaagtcctgtatctgctatggatagtgttggaaatcaaagtcaaggtaatgttttagagcgtcgccaacgtgatgcggaaaacaaaagtcagggtaatgttttagagcgtcgccaacgtgatgcggaaaacaagagccaaggcaatgttttagagcgtcgtcaacgcgatgttgagaataagagccaaggcaatgttttagagcgtcgtcaacgtgatgcggaaaacaaaagtcagggcaatgttctagagcgccgccaacgtgatgcggataacaagagccaagtaggtcaacttatagggaaaaatccacttttttcaaagccaactgtatctagagaaaataatcactctagtcaaggtgactctaacaaacagtcattctctaaaaaagtatctcaggttactaatgtagctaatagaccgatgttaactaataattctagaacaatttcagtgataaataaattacctaaaacaggtggtgatcaaaatgtcatttttaaacttgtaggttttggtttaattttgttaacaagtcgctgcggtttgagacgcaatgaaaattaa

SEQ ID NO: 77 - DNA, 1329 bp, Streptococcus agalactiae
ttgttcaataaaataggttttagaacttggaaatcaggaaagctttggctttatatgggagtgctaggatcaactattattttaggatcaagtcctgtttctgctatggatagtgatggaaatcaaagtcagggcaatgttttagagcgtcgtcaacgtgatgcggaaaacaagagccaaggcaatgttctagagcgtcgtcaacgcgatgcagaaaacagaagccaaggtaatgatctagagcgtcgccaacgtgacgttgagaacaagagccaaggtaacgttctagagcgtcgtcaacgtgatgcagataacaagagccagggcaatgttttagagcgtcgccaacgtgatgttgagaacaagagccaaggtaatgttctagagcgtcgccaaaataatgtccttattaagagtcaagataatgatctagagcgccgccaacgtgatgcggataacaagagccagggtaacgttctagagcgtcgccaacgtgatgttgagaacaagagccaaggtaatgttctagagcgccgccaacgtgatgcggataacaagagccagggtaacgttctagagtgtcgccaacgtgatgttgagaacaagagccaaggtaatgttctagagcgtcgtcaacgtgatgcggaaaacaagagccaaggcaatgttctagagcgtcgtcaacgcgatgcagaaaacagaagccaaggtaatgttctagagcgtcgccaacgtgacgttgagaacaagagccaaggtaacgttctagagcgtcgtcaacgtgatgcagataacaagagccagggcaatgttttagagcgtcgccaacgtgatgttgagaacaagagccaaggtaatgttctagagcgtcgccaaaataatgtccttattaagagtcaagataatgttctagagcgccgccaacgtgatgcggataacaagagccagggtaacgttctagagcgtcgccaacgtgatgttgagaacaagagccaaggcaatgttttagagcgtcgtcaacgcgatgttgagaataagagtcaagtaggtcaacttatagggaaaaatccacttttttcaaagtcaactgtatctagagaaaataatcactctagtcaaggtgactctaacaaacagtcattctctaaaaaagtatctcaggttactaatgtagctaatagaccgatgttaactaataattctagaacaatttcagtgataaataaattacctaaaacaggtgatgatcaaaatgtcatttttaaacttgtaggttttggtttaattttattaacaagtctctgcggtttgagacgcaatgaaaattaa

SEQ ID NO: 78 - DNA, 993 bp, Streptococcus agalactiae
ttgttcaataaaataggttttagaacttggaaatcaggaaagctttggctttatatgggagtgctaggatcaactattattttaggatcaagtcctgtatctgctatggatagtgttggaaatcaaagtcagggcaatgttttagagcgtcgtcaacgcgatgttgagaataagagccaaggtaatgttctagagcgtcgtcaacgtgatgcggaaaacaagagccaaggcaatgttttagagcgtcgtcaacgtgatgcagaaaacagaagccaaggcaatgttttagagcgtcgtcaacgtgatgcagaaaacagaagccaaggcaatgttttagagcgtcgtcaacgcgatgttgagaataagagccaaggtaatgttctagagcgtcgtcaacgcgatgttgagaataagagccaaggtaatgttctagagcgtcgtcaacgtgatgcggaaaacaagagccaaggcaatgttttagagcgtcgtcaacgtgatgcagaaaacagaagccaaggcaatgttttagagcgtcgtcaacgtgatgcagaaaacagaagccaaggcaatgttttagagcgtcgtcaacgcgatgttgagaataagagccaaggcaatgttttagagcgtcgtcaacgtgatgcagaaaacagaagccaaggcaatgttttagagcgtcgtcaacgtgatgcagaaaacagaagccaagtaggtcaacttatagggaaaaatccacttctttcaaagtcaattatatctagagaaaataatcactctagtcaaggtgactctaacaaacagtcattctctaaaaaagtatctcaggttactaatgtagctaatagaccgatgttaactaataattctagaacaatttcagtgataaataaattacctaaaacaggtgatgatcaaaatgtcatttttaaacttgtaggttttggtttaattttgttaacaagtcgctgcggtttgagacgcaatgaaaattaa

SEQ ID NO: 79 - protein, 403 aa, Streptococcus agalactiae
FSVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFTLDAVKKYNSDKLELVFDTVESLICDELEDQEFQKFKKKVLNNFKYIKPAHLRNLSNRGIGIMESQHRKITYRMKRRGMYWSKWGISTMANMIIFERANGLRELFFGSWRKVYSEYKEGSFSAGRLFKKTDELDKFSKPLLKNGRKWSITGIKTK

SEQ ID NO: 80 - protein, 403 aa, Streptococcus agalactiae
FSVTYSQSERTVVFSFGEITFSRSRWTNGFETRIPVDEWLGLEKYKRYSIEFLYHVAKLATMMPYCQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIIFERANGLRELFFGSWRKVYSEYKEGSFSAGRLFKKTDELYKFSKPLLKNGRKWSITGIKTK

SEQ ID NO: 81 - protein, 403 aa, Streptococcus agalactiae
FSVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIKTK

SEQ ID NO: 82 - protein, 444 aa, Streptococcus agalactiae
MEVKKFSEKDFVNEINKIKQKQFLSQIEQYESYIAPQMRTKGYKRINQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELRDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIKTK

SEQ ID NO: 83 - protein, 403 aa, Streptococcus agalactiae; identical to SEQ ID NO: 81

SEQ ID NO: 84 - protein, 403 aa, Streptococcus agalactiae; identical to SEQ ID NO: 81

SEQ ID NO: 85 - DNA, 1212 bp, Streptococcus agalactiae
tttagtgtaacctattcacagtctgaacgtacggttgttttctcttttggagaaataacatttagtaggagtcgctggacaaatggctttgaaactagaataccagtagatgagtggttaggtcttgaaaaatataagagatattcaatagaattcttatatcatgttgcaaaattggctacaatgatgccttatcgtcaagtttgcaaagtaatagatagcactttgcaaacaatcataacaaaagactgtgttttaaaagcagtaaaatttgtagaaaaattgttaaaagaaaaagaacgctatcgtttttatttggaagagccacccgaacgtaaaaaagtgaaaaaactgtatgttgagggtgatggagtcatgattaaaagcacagattctagagaggaaagaaggtatttagatttaacacattttgttattcatacaggctcaaaaaaagtttctactaaaagatatgaattgcaggacaagcacgaaatattacagcttaattatgataaagctaaatataatcttttagattatatttataataactatgaagtagatgacgatactattttaatcactaactctgatatgggtaaaggctatactagtagagtttttaaggaattaggaaaagcacttaaggtaaagaaacatgagcatttttgggatatctatcatgttaaagaaaagttaagttcataccttagaaaatatccaattgaattaaccgattttactttagatgcggtaaaaaaatataattctgataagcttgaattagtttttgatactgttgaatcactgatttgtgatgaacttgaagatcaagaatttcagaagtttaagaaaaaagtattaaataatttcaaatatataaaaccagctcatcttagaaatctttcaaatcgtggtattggtatcatggaatcacaacacagaaagataacgtatagaatgaagcgacgtggcatgtattggtcaaagtggggaatctccacaatggcaaatatgattatatttgaaagagctaacggtttacgagaattatttttcggttcttggagaaaggtatacagtgagtataaagaaggttcatttagtgcagggcgactttttaaaaagacagatgaattagataaattttctaagccccttctaaaaaatggcagaaaatggagtataacaggaatcaaaacaaaatag

SEQ ID NO: 86 - DNA, 1212 bp, Streptococcus agalactiae
tttagtgtaacctattcacagtctgaacgtacggttgttttctcttttggagaaataacatttagtaggagtcgctggacaaatggctttgaaactagaataccagtagatgagtggttaggtcttgaaaaatataagagatattcaatagaattcttatatcatgttgcaaaattggctacaatgatgccttattgtcaagtttgcaaagtaatagatagcactttgcaaacaatcataacaaaagactgtgttttaaaagcagtaaaatttgtagaaaaattgttaaaagaaaaagaacgctatcgtttttatttggaagagccacccgaacgtaaaaaagtgaaaaaactgtatgttgagggtgatggagtcatgattaaaagcacagattctagagaggaaagaaggtatttagatttaacacattttgttattcatacaggctcaaaaaaagtttctactaaaagatatgaattgcaggacaagcacgaaatattacagcttaattatgataaagctaaatataatcttttagattatatttataataactatgaagtagatgacgatactattttaatcactaactctgatatgggtaaaggctatactagtagagtttttaaggaattaggaaaagcacttaaggtaaagaaacatgagcatttttgggatatctatcatgttaaagaaaagttaagttcataccttagaaaatatccaattgaattaaccgattttgctttagatgcggtaaaaaaatataattctgataagcttgaattagtttttgatactgttgaatcactgatttgtgatgaacttgaagatcaagaatttcagaagtttaagaaaaaagtattaaataatttcaaatatataaaaccagctcatcttagaaatctttcaaatcgtggtattggtatcatggaatcacaacacagaaagataacgtatagaatgaagcgacgtggcatgtattggtcaaagtggggaatctccacaatggcaaatatgattatatttgaaagagctaacggtttacgagaattatttttcggttcttggagaaaggtatacagtgagtataaagaaggttcatttagtgcagggcgactttttaaaaagacagatgaattatataaattttctaagccccttctaaaaaatggcagaaaatggagtataacaggaatcaaaacaaaatag

SEQ ID NO: 87 - DNA, 1212 bp, Streptococcus agalactiae
tttagtgtaacctattcacagtctgaacgtacggttgttttctcttttggagaaataacatttagtaggagtcgctggacaaatggctttgaaactagaataccagtagatgagtggttaggtcttgaaaaatataagagatattcaatagaattcttatatcatgttgcaaaattggctacaatgatgccttatcgtcaagtttgcaaagtaatagatagcactttgcaaacaatcataacaaaagactgtgttttaaaagcagtaaaatttgtagaaaaattgttaaaagaaaaagaacgctatcgtttttatttggaagagccacccgaacgtaaaaaagtgaaaaaactgtatgttgagggtgatggagtcatgattaaaagcacagattctagagaggaaagaaggtatttagatttaacacattttgttattcatacaggctcaaaaaaagtttctactaaaagatatgaattgcaggacaagcacgaaatattacagcttaattatgataaagctaaatataatcttttagattatatttataataactatgaagtagatgacgatactattttaatcactaactctgatatgggtaaaggctatactagtagagtttttaaggaattaggaaaagcacttaaggtaaagaaacatgagcatttttgggatatctatcatgttaaagaaaagttaagttcataccttagaaaatatccaattgaattaaccgattttgctttagatgcggtaaaaaaatataattctgataagcttgaattagtttttgatactgttgaatcactgatttgtgatgaacttgaagatcaagaatttcagaagtttaagaaaaaagtattaaataatttcaaatatataaaaccagctcatcttagaaatctttcaaatcgtggtattggtatcatggaatcacaacacagaaagataacgtatagaatgaagcgacgtggcatgtattggtcaaagtggggaatctccacaatggcaaatatgattatacttgaaagagctaacggtttacgagaattatttttcggttcttggagaaaggtatacagtgagtataaagaaggttcatttagtgcagggcgactttttaaaaagacagatgaattagataaattttctaagccccttctaaaaaatggcagaaaatggagtataacaggaatcaaaacaaaatag

SEQ ID NO: 88 - DNA, 1335 bp, Streptococcus agalactiae
atggaagttaaaaaattctcggaaaaagattttgtaaatgaaataaataaaataaaacagaaacaatttttaagtcaaattgaacagtatgaaagctatatcgctcctcaaatgagaacgaaaggctataagaggatcaatcagtctgaacgtacggttgttttctcttttggagaaataacatttagtaggagtcgctggacaaatggctttgaaactagaataccagtagatgagtggttaggtcttgaaaaatataagagatattcaatagaattcttatatcatgttgcaaaattggctacaatgatgccttatcgtcaagtttgcaaagtaatagatagcactttgcaaacaatcataacaaaagactgtgttttaaaagcagtaaaatttgtagaaaaattgttaaaagaaaaagaacgctatcgtttttatttggaagagccacccgaacgtaaaaaagtgaaaaaactgtatgttgagggtgatggagtcatgattaaaagcacagattctagagaggaaagaaggtatttagatttaacacattttgttattcatacaggctcaaaaaaagtttctactaaaagatatgaattgcgggacaagcacgaaatattacagcttaattatgataaagctaaatataatcttttagattatatttataataactatgaagtagatgacgatactattttaatcactaactctgatatgggtaaaggctatactagtagagtttttaaggaattaggaaaagcacttaaggtaaagaaacatgagcatttttgggatatctatcatgttaaagaaaagttaagttcataccttagaaaatatccaattgaattaaccgattttgctttagatgcggtaaaaaaatataattctgataagcttgaattagtttttgatactgttgaatcactgatttgtgatgaacttgaagatcaagaatttcagaagtttaagaaaaaagtattaaataatttcaaatatataaaaccagctcatcttagaaatctttcaaatcgtggtattggtatcatggaatcacaacacagaaagataacgtatagaatgaagcgacgtggcatgtattggtcaaagtggggaatctccacaatggcaaatatgattatacttgaaagagctaacggtttacgagaattatttttcggttcttggagaaaggtatacagtgagtataaagaaggttcatttagtgcagggcgactttttaaaaagacagatgaattagataaattttctaagccccttctaaaaaatggcagaaaatggagtataacaggaatcaaaacaaaatag

SEQ ID NO: 89 - DNA, 1212 bp, Streptococcus agalactiae; identical to SEQ ID NO: 87

SEQ ID NO: 90 - DNA, 1212 bp, Streptococcus agalactiae; identical to SEQ ID NO: 87

SEQ ID NO: 91 - protein, 682 aa, Streptococcus agalactiae
MKKINKFFVAFSALLLILTSLLSVAPAFAEKEKTTETVTLHKILQTDTNLKNSAFPGTKGLDGTEYDGKAIDKLDSYFGNDSKDIGGAYFILANSKGEYIKANDKNKLKPEFSGNTPKTTLNISEAVGGLTEENAGIKFETTGLRGDFQIIELKDKSTYNNGGAILADSKAVPVKITLPLINKDGVVKDAHVYPKNTETKPQIDKNFADKNLDYINNQKDKGTISATVGDVKKYTVGTKILKGSDYKKLVWTDSMTKGLTFNNDVTVTLDGANFEQSNYTLVADDQGFRLVLNATGLSKVAEAAKTKDVEIKINYSATVNGSTVVEKSENNDVKLDYGNNPTTENEPQTGNPVNKEITVRKTWAVDGNEVNKGDEKVDAVFTLQVKDSDKWVNVDSATATAATDFKYTFKNLDNAKTYRVVERVSGYAPAYVSFVGGVVTIKNNKNSNDPTPINPSEPKVVTYGRKFVKTNQDGSERLAGATFLVKNSQSQYLARKSGVATNEAHKAVTDAKVQLDEAVKAYNKLTKEQQESQDGKAALNLIDEKQTAYNEAFAKANYSYEWVVDKNAANVVKLISNTAGKFEITGLNAGEYSLEETQAPTGYAKLSSDVSFKVNDTSYSEGASNDIAYDKDSGKTDAQKVVNKKVTIPQTGGIGTILFTIIGLSIMLGAVVIMKRRQSEEA

SEQ ID NO: 92 - protein, 675 aa, Streptococcus agalactiae
MKKINKYFAVFSALLLTVTSLFSVAPVFAEEAKTTDTVTLHKIVMPRTAFDGFTAGTKGKDNTDYVGKQIEDLKTYFGSGEAKEIAGAYFAFKNEAGTKYITENGEEVDTLDTTDAKGGAVLKGLTTDNGFKFNTSKLTGTYQIVELKEKSTYNNDGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYIDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVTIPQTGGIGTIFFTIIGLSIMLGAVVIMKRRQSEEV

SEQ ID NO: 93 - protein, 693 aa, Streptococcus agalactiae
MKRINKYFAMFSALLLILTSLLSVAPVFAAEMGNITKTVTLHKIVQTSDNLAKPNFPGINGLNGTKYMGQKLTDISGYFGQGSKEIAGAFFAVMNESQTKYITESGTEVESIDAAGVLKGLTTENGITFNTANLKGTYQIVELLDKSNYKNGDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETQAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVTIPQTGGIGTILFTIIGLSIMLGAVIIMKRRQSEEA

SEQ ID NO: 94 - protein, 704 aa, Streptococcus agalactiae
MKKINKYFAVFSALLLTVTSLLSVAPAFADEATTNTVTLHKILQTESNLNKSNFPGTTGLNGDDYKGESISDLAEYFGSGSKEIDGAFFALALEEEKDGVVQYVKAKANDKLTPDLITKGTPATTTKVEEAVGGLTTGTGIVFNTAGLKGNFKIIELKDKSTYNNNGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYIWVDEKTKAITFTSNNQGQFEVTGLEVGSYKLEETLAPAGYAKLSGDIEFTVGHDSYTSGDIKYKTDDASNNAQKVFNKKVTIPQTGGIGTILFTIIGLSIMLGAVVIMKRRQSEEA

SEQ ID NO: 95 - protein, 682 aa, Streptococcus agalactiae; identical to SEQ ID NO: 91

SEQ ID NO: 96 - protein, 693 aa, Streptococcus agalactiae
MKRINKYFAMFSALLLILTSLLSVAPVFAAEMGNITKTVTLHKIVQTSDNLAKPNFPGINGLNGTKYMGQKLTDISGYFGQGSKEIAGAFFAVMNESQTKYITESGTEVESIDAAGVLKGLTTENGITFNTANLKGTYQIVELLDKSNYKNGDKVLADSKAVPVKITLPLYNEEGIIVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETHAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVTIPQTGGIGTILFTIIGLSIMLGAVIIMKRRQSEEA

SEQ ID NO: 97 - protein, 674 aa, Streptococcus agalactiae
MKKINKCLTVFSTLLLILTSLFSVAPAFADDVTTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDTGFAFNTAKLKGTYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGKDFPVLNYKLVTDDQGFRLALNATGLAAVAAAAKDKDVEIKITYSATVNGSTTVEVPETNDVKLDYGNNPTEESEPQEGTPANQEIKVIKDWAVDGTITDVNVAVKAIFTLQEKQTDGTWVNVASHEATKPSRFEHTFTGLDNTKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYSLEETQAPAGYATLSGDVNFEVTATSYSKGATTDIAYDKGSVKKDAQQVQNKKVTIPQTGGIGTILFTIIGLSIMLGAVVVMKKRQSEEA

SEQ ID NO: 98 - protein, 674 aa, Streptococcus agalactiae
MKKINKCLTMFSTLLLILTSLFSVAPAFADDATTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDNGFVFNTAKLKGIYQIVELKEKSNYDNNGSILADSKAVPVKITLPLVNNQGVVKDAHIYPKNTETKPQVDKNFADKDLDYTDNRKDKGVVSATVGDKKEYIVGTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVTIPQTGGIGTILFTIIGLSIMLGAVVIMKKRQSEEA

SEQ ID NO: 99 - protein, 674 aa, Streptococcus agalactiae; identical to SEQ ID NO: 98

SEQ ID NO: 100 - protein, 675 aa, Streptococcus agalactiae
MKKINKYFAVFSALLLTVTSLFSVAPVFAEEAKTTDTVTLHKIVMPRTAFDGFTAGTKGKDNTDYVGKQIEDLKTYFGSGEAKEIAGAYFAFKNEAGTKYITENGEEVDTLDTTDAKGGAVLKGLTTDNGFKFNTSKLTGTYQIVELKEKSTYNNDGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVTIPQTGGIGTIFFTIIGLSIMLGAVVIMKRRQSEEV

SEQ ID NO: 101 - protein, 693 aa, Streptococcus agalactiae; identical to SEQ ID NO: 93

SEQ ID NO: 102 - protein, 674 aa, Streptococcus agalactiae; identical to SEQ ID NO: 98

SEQ ID NO: 103 - protein, 693 aa, Streptococcus agalactiae
MKRINKYFAMFSALLLILTSLLSVAPVFAAEMGNITKTVTLHKIVQTSDNLAKPNFPGINGLNGTKYMGQKLTDISGYFGQGSKEIAGAFFAVMNESQTKYITESGTEVESIDAAGVLKGLTTENGITFNTANLKGTYQIVELLDKSNYKNGDKVLADSKAVPVKITLPLYNEEGIVVDAEVYPKNTEEAPQIDKNFAKANKLLNDSDNSAIAGGADYDKYQAEKAKATAEIGQEIPYEVKTKIQKGSKYKNLAWVDTMSNGLTMGNTVNLEASSGSFVEGTDYNVERDDRGFTLKFTDTGLTKLQKEAETHAVEFTLTYSATVNGAAIDDKPESNDIKLQYGNKPGKKVKEIPVTPSNGEITVSKTWDKGSDLENANVVYTLKDGGTAVASVSLTKTTPNGEINLGNGIKFTVTGAFAGKFSGLTDSKTYMISERIAGYGNTITTGAGSAAITNTPDSDNPTPLNPTEPKVVTHGKKFVKTSSTETERLQGAQFVVKDSAGKYLALKSSATISAQTTAYTNAKTALDAKIAAYNKLSADDQKGTKGETAKAEIKTAQDAYNAAFIVARTAYEWVTNKEDANVVKVTSNADGQFEVSGLATGDYKLEETQAPAGYAKLAGDVDFKVGNSSKADDSGNIDYTASSNKKDAQRIENKKVTIPQTGGIGTILFTIIGLSIMLGAVIIMKRRQSEEA

SEQ ID NO: 104 - protein, 674 aa, Streptococcus agalactiae
MKKINKCLTMFSTLLLILTSLFSVAPAFADDATTDTVTLHKIVMPQAAFDNFTEGTKGKNDSDYVGKQINDLKSYFGSTDAKEIKGAFFVFKNETGTKFITENGKEVDTLEAKDAEGGAVLSGLTKDNGFVFNTAKLKGIYQIVELKEKSNYDNNGSILADSKAVPVKITLPLVNNQGVVKDAHIYPKNTETKPQVDKNFADKDLDYTDNRKDKGVVSATVGDKKEYIVVTKILKGSDYKKLVWTDSMTKGLTFNNNVKVTLDGEDFPVLNYKLVTDDQGFRLALNATGLAAVAAAAKDKDVEIKITYSATVNGSTTVEIPETNDVKLDYGNNPTEESEPQEGTPANQEIKVIKDWAVDGTITDANVAVKAIFTLQEKQTDGTWVNVASHEATKPSRFEHTFTGLDNAKTYRVVERVSGYTPEYVSFKNGVVTIKNNKNSNDPTPINPSEPKVVTYGRKFVKTNQANTERLAGATFLVKKEGKYLARKAGAATAEAKAAVKTAKLALDEAVKAYNDLTKEKQEGQEGKTALATVDQKQKAYNDAFVKANYSYEWVADKKADNVVKLISNAGGQFEITGLDKGTYGLEETQAPAGYATLSGDVNFEVTATSYSKGATTDIAYDKGSVKKDAQQVQNKKVTIPQTGGIGTILFTIIGLSIMLGAVVIMKKRQSEEA

SEQ ID NO: 105 - protein, 674 aa, Streptococcus agalactiae; identical to SEQ ID NO: 98

SEQ ID NO: 106 - protein, 674 aa, Streptococcus agalactiae; identical to SEQ ID NO: 98

SEQ ID NO: 107 - protein, 674 aa, Streptococcus agalactiae; identical to SEQ ID NO: 98

SEQ ID NO: 108 - protein, 674 aa, Streptococcus agalactiae; identical to SEQ ID NO: 98

SEQ ID NO: 109 - protein, 674 aa, Streptococcus agalactiae; identical to SEQ ID NO: 97

SEQ ID NO: 110 - protein, 705 aa, Streptococcus agalactiae
MKRINKYFAMFSALLLTLTSLLSVAPAFADEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVTIPQTGGIGTILFTIIGLSIMLGAVVIMKRRQSKEA

SEQ ID NO: 111 - protein, 674 aa, Streptococcus agalactiae; identical to SEQ ID NO: 98

SEQ ID NO: 112 - protein, 674 aa, Streptococcus agalactiae; identical to SEQ ID NO: 98

SEQ ID NO: 113 - protein, 693 aa, Streptococcus agalactiae; identical to SEQ ID NO: 93

SEQ ID NO: 114 - protein, 674 aa, Streptococcus agalactiae; identical to SEQ ID NO: 98

SEQ ID NO: 115 - protein, 674 aa, Streptococcus agalactiae; identical to SEQ ID NO: 98

SEQ ID NO: 116 - protein, 674 aa, Streptococcus agalactiae; identical to SEQ ID NO: 98

SEQ ID NO: 117 - protein, 674 aa, Streptococcus agalactiae; identical to SEQ ID NO: 98

SEQ ID NO: 118 - protein, 674 aa, Streptococcus agalactiae; identical to SEQ ID NO: 98

SEQ ID NO: 119 - protein, 705 aa, Streptococcus agalactiae; identical to SEQ ID NO: 110

SEQ ID NO: 120 - protein, 675 aa, Streptococcus agalactiae
MKKINKYFAVFSALLLTVTSLFSVAPVFAEEAKTTDTVTLHKIVMPRTAFDGFTAGTKGKDNTDYVGKQIEDLKTYFGSGEAKEIAGAYFAFKNEAGTKYITENGEEVDTLDTTDAKGCAVLKGLTTDNGFKFNTSKLTGTYQIVELKEKSTYNNDGSILADSKAVPVKITLPLVNDNGVVKDAHVYPKNTETKPQVDKNFADKELDYANNKKDKGTVSASVGDVKKYHVGTKILKGSDYKKLIWTDSMTKGLTFNNDIAVTLDGATLDATNYKLVADDQGFRLVLTDKGLEAVAKAAKTKDVEIKITYSATLNGSAVVEVLETNDVKLDYGNNPTIENEPKEGIPVDKKITVNKTWAVDGNEVNKADETVDAVFTLQVKDGDKWVNVDSAKATAATSFKHTFENLDNAKTYRVIERVSGYAPEYVSFVNGVVTIKNNKDSNEPTPINPSEPKVVTYGRKFVKTNKDGKERLAGATFLVKKDGKYLARKSGVATDAEKAAVDSTKSALDAAVKAYNDLTKEKQEGQDGKSALATVSEKQKAYNDAFVKANYSYEWVEDKNAKNVVKLISNDKGQFEITGLTEGQYSLEETQAPTGYAKLSGDVSFNVNATSYSKGSAQDIEYTQGSKTKDAQQVINKKVTIPQTGGIGTIFFTIIGLSIMLGAVVIMKRRQSEEV

SEQ ID NO: 121 - protein, 674 aa, Streptococcus agalactiae; identical to SEQ ID NO: 98

SEQ ID NO: 122 - protein, 674 aa, Streptococcus agalactiae; identical to SEQ ID NO: 98

SEQ ID NO: 123 - protein, 674 aa, Streptococcus agalactiae; identical to SEQ ID NO: 98

SEQ ID NO: 124 - protein, 674 aa, Streptococcus agalactiae; identical to SEQ ID NO: 98

SEQ ID NO: 125 - protein, 705 aa, Streptococcus agalactiae; identical to SEQ ID NO: 110

SEQ ID NO: 126 - protein, 674 aa, Streptococcus agalactiae; identical to SEQ ID NO: 98

SEQ ID NO: 127 - protein, 704 aa, Streptococcus agalactiae
MKKINKYFAVFSALLLTVTSLLSVAPAFADEATTNTVTLHKILQTESNLNKSNFPGTTGLNGDDYKGESISDLAEYFGSGSKEIDGAFFALALEEEKDGVVQYVKAKANDKLTPDLITKGTPATTTKVEEAVGGLTTGTGIVFNTAGLKGNFKIIELKDKSTYNNNGSLLAASKAVPVKITLPLVSKDGVVKDAHVYPKNTETKPEVDKNFAKTNDLTALKDATLLKAGADYKNYSATKATVTAEIGKVIPYEVKTKVLKGSKYEKLVWTDTMSNGLTMGDDVNLAVSGTTTTFIKDIDYTLSIDDRGFTLKFKATGLDKLEEAAKASDVEFTLTYKATVNGQAIIDNPEVNDIKLDYGNKPGTDLSEQPVTPEDGEVKVTKTWAAGANKADAKVVYTLKNATKQVVASVALTAADTKGTINLGKGMTFEITGAFSGTFKGLQNKAYTVSERVAGYTNAINVTGNAVAITNTPDSDNPTPLNPTQPKVETHGKKFVKVGDADARLAGAQFVVKNSAGKFLALKEDAAVSGAQTELATAKTDLDNAIKAYNGLTKAQQEGADGTSAKELINTKQSAYDAAFIKARTAYTWVDEKTKAITFTSNNQGQFEVTGLEVGSYKLEETLAPAGYAKLSGDIEFTVGHDSYTSGDIKYKTDDASNNAQKVFNKKVTIPQTGGIGTILFTIIGLSIMLGAVVIMKRRQSEEA

SEQ ID NO: 128 - protein, 674 aa, Streptococcus agalactiae; identical to SEQ ID NO: 98

SEQ ID NO: 129 - protein, 705 aa, Streptococcus agalactiae; identical to SEQ ID NO: 110

SEQ ID NO: 130 - protein, 674 aa, Streptococcus agalactiae; identical to SEQ ID NO: 98

SEQ ID NO: 131 - protein, 705 aa, Streptococcus agalactiae; identical to SEQ ID NO: 110

SEQ ID NO: 132 - protein, 674 aa, Streptococcus agalactiae; identical to SEQ ID NO: 98

SEQ ID NO: 133 - DNA, 2049 bp, Streptococcus agalactiae
atgaaaaaaatcaacaaattttttgtggcgttctcagcgttgttactgattttaacgtcattgctctcagttgcaccagcgtttgcggaaaaagaaaaaacaactgagactgttactttgcataaaattttacaaactgatacaaaccttaagaatagtgctttccctggtacaaaagggctagatggaactgaatatgacgggaaagctattgataaattggatagctactttggcaatgactcaaaagatattggtggggcttactttatattggcaaatagcaagggtgaatatatcaaagctaatgataaaaataaattaaagcctgagtttagtgggaacactccgaaaacgaccctcaatattagtgaagctgtaggtggtttgacagaagaaaacgcaggtattaagtttgaaaccactggtttaagaggggatttccagattattgaattgaaagacaagtcaacttacaataatggtggggccatcttggctgattcaaaagcggttccagtgaaaatcactcttccattgataaacaaggatggtgttgttaaagatgcacacgtctatccaaagaacactgaaacaaaaccgcaaattgacaagaactttgctgataaaaatcttgattatattaacaaccaaaaagacaaaggtactatatcagcaactgttggtgatgttaaaaaatatactgttgggacaaaaatccttaaaggatctgactataaaaaattagtttggaccgatagcatgacgaaaggattgacgtttaacaacgatgttactgtaacattggatggtgcaaattttgaacaatcaaattacaccttagtagctgatgaccaaggtttccgtcttgtcttgaatgcaacaggtctttctaaagtagcagaagctgcaaaaacaaaagatgttgaaatcaaaatcaactattcagctacagtaaacggttctactgtcgttgaaaagtcagaaaataatgatgtcaaactagattatggtaacaacccaacaactgaaaacgaaccacaaactggtaatccagttaacaaagaaatcacagttcgaaagacttgggcagtggatggtaatgaagtgaataagggagatgaaaaagttgacgctgtcttcacgttgcaagttaaagatagtgacaaatgggtgaatgtcgattcagcaacagcaacagcagcaactgacttcaaatacactttcaaaaacttggataatgccaaaacttaccgtgttgtagaacgtgttagcggctacgctccagcctacgtttcatttgtgggtggagttgtgactattaagaataacaaaaactcaaatgacccaactccaatcaatccatcagaaccaaaagttgtgacttatggacgtaaatttgtgaaaacaaatcaagatggctctgaacgtctagcaggagctactttccttgttaagaactcacaaagtcaatacttggcacgtaaatcaggtgttgcaactaatgaagctcacaaagcagtaacagatgctaaagtacaactggatgaagctgttaaagcttataacaaattgactaaagaacaacaagaaagtcaagatggtaaagcagcattgaatcttattgatgaaaaacaaacagcttacaatgaagcttttgctaaagcaaactactcatatgaatgggttgtagataaaaacgctgcaaacgttgttaaattgatttctaatacagctggtaaatttgaaattacaggtttgaatgcaggcgagtatagtttggaagagactcaagcaccaacaggttatgctaaattgtcaagtgatgtatcatttaaagtaaatgatacatcgtatagcgaaggggcttcaaatgatattgcatacgataaagactccggtaaaacagatgcacaaaaagttgtcaacaaaaaagtaacaatcccacaaacaggtggtattggtacaattcttttcacaattattggtttaagcattatgcttggagcggtagttatcatgaaaagacgtcaatcagaggaagcttaa

SEQ ID NO: 134 - DNA, 2028 bp, Streptococcus agalactiae
atgaaaaaaatcaacaaatattttgcagtcttctcggcattgctactgaccgtaacatcattgttctcagttgcaccagtgtttgcggaagaagcaaaaactactgacacagtgaccttgcacaagattgtcatgcctcgaactgcatttgacggttttactgctggtacaaagggtaaggataatactgactacgttggtaaacaaatcgaagaccttaaaacttactttggctcaggcgaagcgaaagaaatcgcaggtgcttactttgctttcaaaaatgaagctggtactaaatacatcactgaaaatggtgaagaagttgatactttggatacaacagatgccaaaggtggtgctgttcttaaaggtttaacaacagacaatggtttcaaatttaacacttctaaattaacaggaacttaccaaatcgttgaattgaaagaaaaatctacatacaacaacgatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaatatcatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacattgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttactattccacaaacaggtggtattggtacaatttttttcacaattattggattaagtattatgcttggagcggtagttatcatgaaaagacgtcaatcagaggaagtttaa

SEQ ID NO: 135 - DNA, 2082 bp, Streptococcus agalactiae
atgaaaagaatcaacaaatattttgcaatgttctcggcattgttattaattttaacatcgttgttatcggtagctccggtatttgctgctgagatgggaaatatcactaaaacagtaaccttacacaaaattgttcaaacatccgataatttggctaagccaaatttcccaggaataaatggattgaatggaacgaagtatatgggtcaaaaacttactgacatttcaggatattttgggcaaggttctaaagaaatcgccggtgctttctttgcggttatgaatgaaagtcagacaaaatatatcacagaaagtggtactgaagtagaaagtatcgatgcagcaggtgtccttaaaggtttgacaactgaaaacggcattacatttaatactgcaaacttaaaaggaacataccaaatcgttgagttgcttgacaaatctaattataaaaatggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacaagctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgactattccacaaacaggtggtattggtacaattcttttcacaattattggtttaagcattatgcttggagcggtaattatcatgaaaagacgtcaatcagaggaagcttaa

SEQ ID NO: 136 - DNA, 2115 bp, Streptococcus agalactiae
atgaaaaaaatcaacaaatattttgcagtcttctcggccttgctactgaccgtaacatcattgctctcagttgcaccagcgtttgcggacgaagcaacaactaatacagtgactttgcacaagatcttgcaaactgaatcaaatcttaataaaagtaacttcccaggaactacaggccttaacggagatgactataaaggtgaatctatttctgaccttgctgaatactttggatcaggttctaaagaaattgacggtgctttctttgctttggctttagaagaggaaaaagatggtgtcgtacaatatgttaaggcaaaagcaaatgacaaattaacaccagacttaattactaaaggtacacctgcaacaacaacaaaagttgaagaagctgtaggtggtttgacaactggtacgggtattgttttcaatacagctggtttgaaaggtaatttcaaaattattgaattgaaagacaaatcaacttacaacaataatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatatatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaaccatcccacaaacaggtggtattggtacaattcttttcacaattattggtttaagcattatgcttggagcggtagttatcatgaaaagacgtcaatcagaggaagcttaa

SEQ ID NO: 137 - DNA, 2049 bp, Streptococcus agalactiae; identical to SEQ ID NO: 133

SEQ ID NO: 138 - DNA, 2082 bp, Streptococcus agalactiae
atgaaaagaatcaacaaatattttgcaatgttctcggcattgttattaattttaacatcgttgttatcggtagctccggtatttgctgctgagatgggaaatatcactaaaacagtaaccttacacaaaattgttcaaacatccgataatttggctaagccaaatttcccaggaataaatggattgaatggaacgaagtatatgggtcaaaaacttactgacatttcaggatattttgggcaaggttctaaagaaatcgccggtgctttctttgcggttatgaatgaaagtcagacaaaatatatcacagaaagtggtactgaagtagaaagtatcgatgcagcaggtgtccttaaaggtttgacaactgaaaacggcattacatttaatactgcaaacttaaaaggaacataccaaatcgttgagttgcttgacaaatctaattataaaaatggtgacaaagttcttgctgactcaaaagctgtcccagtgaaaatcactcttcctttgtataacgaagaaggaattatcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacacgctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgactattccacaaacaggtggtattggtacaattcttttcacaattattggtttaagcattatgcttggagcggtaattatcatgaaaagacgtcaatcagaggaagcttaa

SEQ ID NO: 139 - DNA, 2025 bp, Streptococcus agalactiae
atgaaaaaaatcaacaaatgtcttacagtgttctcgacactgctattgatcttaacgtcactattctcagttgcaccagcgtttgcggacgacgtaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaattaagggtgctttctttgttttcaaaaatgaaactggtacaaaattcattactgaaaatggtaaggaagtcgatactttggaagctaaagatgctgaaggtggtgctgttctttcagggttaacaaaagacactggttttgcttttaacactgctaagttaaaaggaacttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtaaagattttcctgttttaaactacaaactcgtaacagatgaccaaggtttccgtcttgccttgaatgcaacaggtcttgcagcagtagcagctgctgcaaaagacaaagatgttgaaatcaagatcacttactcagctacggtgaacggctccactactgttgaagttccagaaaccaatgatgttaaattggactatggtaataacccaacggaagaaagtgaaccacaagaaggtactccagctaaccaagaaattaaagtcattaaagactgggcagtagatggtacaattactgatgttaatgttgcagttaaagctatctttaccttgcaagaaaaacaaacggatggtacatgggtgaacgttgcttcacacgaagcaacaaaaccatcacgctttgaacatactttcacaggtttggataatactaaaacttaccgcgttgtcgaacgtgttagcggctacactccagaatatgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttccttgttaagaaagaaggaaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatagcttggaagaaactcaagcaccagcaggttatgcgacattgtcaggtgatgtaaactttgaagtaactgccacatcatatagcaaaggggctacaactgacatcgcatatgataaaggatctgtaaaaaaagatgcccaacaagttcaaaacaaaaaagtaaccatcccacaaacaggtggtattggtacaattcttttcacaattattggtttaagcattatgcttggagcagtagttgtcatgaaaaaacgtcaatcagaggaagcttaa

SEQ ID NO: 140 - DNA, 2025 bp, Streptococcus agalactiae
atgaaaaaaatcaacaaatgtcttacaatgttctcgacactgctattgatcttaacgtcactattctcagttgcaccagcgtttgcggacgacgcaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaatcaagggtgctttctttgttttcaaaaatgaaactggtacaaaattcattactgaaaatggtaaggaagtcgatactttggaagctaaagatgctgaaggtggtgctgttctttcagggttaacaaaagacaatggttttgtttttaacactgctaagttaaaaggaatttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttggaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaaccatcccacaaacaggtggtattggtacaattcttttcacaattattggtttaagcattatgcttggagcagtagttatcatgaaaaaacgtcaatcagaggaagcttaa

SEQ ID NO: 141 - DNA, 2025 bp, Streptococcus agalactiae; identical to SEQ ID NO: 140

SEQ ID NO: 142 - DNA, 2028 bp, Streptococcus agalactiae
atgaaaaaaatcaacaaatattttgcagtcttctcggcattgctactgaccgtaacatcattgttctcagttgcaccagtgtttgcggaagaagcaaaaactactgacacagtgaccttgcacaagattgtcatgcctcgaactgcatttgacggttttactgctggtacaaagggtaaggataatactgactacgttggtaaacaaatcgaagaccttaaaacttactttggctcaggcgaagcgaaagaaatcgcaggtgcttactttgctttcaaaaatgaagctggtactaaatacatcactgaaaatggtgaagaagttgatactttggatacaacagatgccaaaggtggtgctgttcttaaaggtttaacaacagacaatggtttcaaatttaacacttctaaattaacaggaacttaccaaatcgttgaattgaaagaaaaatctacatacaacaacgatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaatatcatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttactattccacaaacaggtggtattggtacaatttttttcacaattattggattaagtattatgcttggagcggtagttatcatgaaaagacgtcaatcagaggaagtttaa

SEQ ID NO: 143 - DNA, 2082 bp, Streptococcus agalactiae; identical to SEQ ID NO: 135

SEQ ID NO: 144 - DNA, 2025 bp, Streptococcus agalactiae; identical to SEQ ID NO: 140

SEQ ID NO: 145 - DNA, 2082 bp, Streptococcus agalactiae
atgaaaagaatcaacaaatattttgcaatgttctcggcattgttattaattttaacatcgttgttatcggtagctccggtatttgctgctgagatgggaaatatcactaaaacagtaaccttacacaaaattgttcaaacatccgataatttggctaagccaaatttcccaggaataaatggattgaatggaacgaagtatatgggtcaaaaacttactgacatttcaggatattttgggcaaggttctaaagaaatcgccggtgctttctttgcggttatgaatgaaagtcagacaaaatatatcacagaaagtggtactgaagtagaaagtatcgatgcagcaggtgtccttaaaggtttgacaactgaaaacggcattacatttaatactgcaaacttaaaaggaacataccaaatcgttgagttgcttgacaaatctaattataaaaatggtgacaaagttcttgctgactcaaaagctgtcccagtgaaaatcactcttcctttgtataacgaagaaggaattgtcgtggacgctgaagtgtatccaaagaatacagaagaagcaccacaaatcgacaaaaactttgctaaagcaaataaattgttgaatgacagtgataattcagctattgcaggtggggcagactacgacaaatatcaggcagaaaaagcaaaagctactgctgaaatcggtcaagaaatcccttacgaagttaaaacaaaaatccaaaaagggtctaaatacaaaaaccttgcttgggtcgataccatgtcaaatggtttgacaatgggtaacactgttaacttagaagcatcgtcaggctcttttgtagaaggtacagattacaatgttgaacgtgatgaccgtggtttcactttgaaattcacagatacaggtttgactaagctacaaaaagaagcggaaacacacgctgttgaattcacattgacatatagcgcaacagttaacggtgcggctattgatgacaagccagaaagcaatgatatcaaacttcaatacggtaacaaaccaggtaaaaaagtaaaagaaatcccagtaacaccgtcaaatggcgaaatcactgttagcaaaacttgggacaaaggttcagatttagagaatgcgaatgttgtttatacccttaaagatggtggaacagctgttgcctcagtttcattgacaaaaacaacaccaaatggcgaaatcaacttaggtaatggtattaaatttacagttactggagcgtttgctggtaaattcagtggtctgactgatagtaaaacatacatgatctcagaacgtatcgctggttatggtaatacaatcactactggtgctggtagtgcagctatcaccaatactccagattcagacaacccaacaccacttaatccaactgaaccaaaagttgtgacacacggtaaaaaattcgtcaaaacaagttcgactgaaacagaacgcttgcaaggtgcacagttcgttgttaaagattcagctggtaaataccttgcattgaaatcatctgcgacaatatcagctcaaacaacagcttacacaaatgctaaaactgctcttgacgctaaaatcgcagcttacaacaaactttcagcagacgatcaaaaaggtactaaaggtgaaacagctaaagcagaaatcaaaactgctcaagacgcttacaatgcagccttcatcgtagctcgtacagcttacgagtgggtaactaataaagaagatgctaacgttgttaaagtgacttcaaacgctgacggtcaatttgaagttagcggtcttgcaactggtgattataaacttgaagaaacacaagctccagctggttacgctaaattagcaggtgatgttgatttcaaagttggaaacagctcaaaagcagacgactcaggtaacattgattacactgctagcagcaataaaaaagacgctcaacgcatagaaaacaaaaaagtgactattccacaaacaggtggtattggtacaattcttttcacaattattggtttaagcattatgcttggagcggtaattatcatgaaaagacgtcaatcagaggaagcttaa

SEQ ID NO: 146 - DNA, 2025 bp, Streptococcus agalactiae
atgaaaaaaatcaacaaatgtcttacaatgttctcgacactgctattgatcttaacgtcactattctcagttgcaccagcgtttgcggacgacgcaacaactgatactgtgaccttgcacaagattgtcatgccacaagctgcatttgataactttactgaaggtacaaaaggtaagaatgatagcgattatgttggtaaacaaattaatgaccttaaatcttattttggctcaaccgatgctaaagaaatcaagggtgctttctttgttttcaaaaatgaaactggtacaaaattcattactgaaaatggtaaggaagtcgatactttggaagctaaagatgctgaaggtggtgctgttctttcagggttaacaaaagacaatggttttgtttttaacactgctaagttaaaaggaatttaccaaatcgttgaattgaaagaaaaatcaaactacgataacaacggttctatcttggctgattcaaaagcagttccagttaaaatcactctgccattggtaaacaaccaaggtgttgttaaagatgctcacatttatccaaagaatactgaaacaaaaccacaagtagataagaactttgcagataaagatcttgattatactgacaaccgaaaagacaaaggtgttgtctcagcgacagttggtgacaaaaaagaatacatagttgtaacaaaaattcttaaaggctcagactataagaaactggtttggactgatagcatgactaaaggtttgacgttcaacaacaacgttaaagtaacattggatggtgaagattttcctgttttaaactacaaactcgtaacagatgaccaaggtttccgtcttgccttgaatgcaacaggtcttgcagcagtagcagcagctgcaaaagacaaagatgttgaaatcaagatcacttactcagctacggtgaacggctccactactgttgaaattccagaaaccaatgatgttaaattggactatggtaataacccaacggaagaaagtgaaccacaagaaggtactccagctaaccaagaaattaaagtcattaaagactgggcagtagatggtacaattactgatgctaatgttgcagttaaagctatctttaccttgcaagaaaaacaaacggatggtacatgggtgaacgttgcttcacacgaagcaacaaaaccatcacgctttgaacatactttcacaggtttggataatgctaaaacttaccgcgttgtcgaacgtgttagcggctacactccagaatacgtatcatttaaaaatggtgttgtgactatcaagaacaacaaaaactcaaatgatccaactccaatcaacccatcagaaccaaaagtggtgacttatggacgtaaatttgtgaaaacaaatcaagctaacactgaacgcttggcaggagctaccttcctcgttaagaaagaaggcaaatacttggcacgtaaagcaggtgcagcaactgctgaagcaaaggcagctgtaaaaactgctaaactagcattggatgaagctgttaaagcttataacgacttgactaaagaaaaacaagaaggccaagaaggtaaaacagcattggctactgttgatcaaaaacaaaaagcttacaatgacgcttttgttaaagctaactactcatatgaatgggttgcagataaaaaggctgataatgttgttaaattgatctctaacgccggtggtcaatttgaaattactggtttggataaaggcacttatggcttggaagaaactcaagcaccagcaggttatgcgacattgtcaggtgatgtaaactttgaagtaactgccacatcatatagcaaaggggctacaactgacatcgcatatgataaaggctctgtaaaaaaagatgcccaacaagttcaaaacaaaaaagtaaccatcccacaaacaggtggtattggtacaattcttttcacaattattggtttaagcattatgcttggagcagtagttatcatgaaaaaacgtcaatcagaggaagcttaa

SEQ ID NO: 147 - DNA, 2025 bp, Streptococcus agalactiae; identical to SEQ ID NO: 140

SEQ ID NO: 148 - DNA, 2025 bp, Streptococcus agalactiae; identical to SEQ ID NO: 140

SEQ ID NO: 149 - DNA, 2025 bp, Streptococcus agalactiae; identical to SEQ ID NO: 140

SEQ ID NO: 150 - DNA, 2028 bp, Streptococcus agalactiae; identical to SEQ ID NO: 142

SEQ ID NO: 151 - DNA, 2025 bp, Streptococcus agalactiae; identical to SEQ ID NO: 139

SEQ ID NO: 152 - DNA, 2118 bp, Streptococcus agalactiae
atgaaaagaatcaacaaatattttgcaatgttctcggcattgttactgactttaacgtcattgctctcagttgcaccagcgtttgcggatgaagcaacaactaatacagtgactttgcacaagattttgcaaaccgaatcaaatcttaacaaaagtaacttcccaggaactacaggtcttaacggaaaagactacaaaggtggagctatttctgaccttgctggttactttggcgagggatctaaagaaatcgaaggtgcgttctttgctttagctttgaaagaagataaaagtggtaaagtgcaatatgttaaggcaaaagaaggtaacaaattaacaccagccttaattaataaagatggtactcctgaaataacagtaaatattgatgaggccgtgtctggattgacaccagagggagatactggacttgttttcaacaccaaaggattgaaaggcgagtttaaaattgttgaagttaaatcaaaatctacttacaacaataatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaacaatcccacaaacaggtggtattggtacaattcttttcacaattattggtttaagcattatgcttggagcagtagttatcatgaaaagacgccaatcaaaggaagcttaa

SEQ ID NO: 153 - DNA, 2025 bp, Streptococcus agalactiae; identical to SEQ ID NO: 140

SEQ ID NO: 154 - DNA, 2025 bp, Streptococcus agalactiae; identical to SEQ ID NO: 140

SEQ ID NO: 155 - DNA, 2082 bp, Streptococcus agalactiae; identical to SEQ ID NO: 135

SEQ ID NO: 156 - DNA, 2025 bp, Streptococcus agalactiae; identical to SEQ ID NO: 140

SEQ ID NO: 157 - DNA, 2025 bp, Streptococcus agalactiae; identical to SEQ ID NO: 140

SEQ ID NO: 158 - DNA, 2025 bp, Streptococcus agalactiae; identical to SEQ ID NO: 140

SEQ ID NO: 159 - DNA, 2025 bp, Streptococcus agalactiae; identical to SEQ ID NO: 140

SEQ ID NO: 160 - DNA, 2025 bp, Streptococcus agalactiae; identical to SEQ ID NO: 140

SEQ ID NO: 161 - DNA, 2118 bp, Streptococcus agalactiae; identical to SEQ ID NO: 152

SEQ ID NO: 162 - DNA, 2028 bp, Streptococcus agalactiae
atgaaaaaaatcaacaaatattttgcagtcttctcggcattgctactgaccgtaacatcattgttctcagttgcaccagtgtttgcggaagaagcaaaaactactgacacagtgaccttgcacaagattgtcatgcctcgaactgcatttgacggttttactgctggtacaaagggtaaggataatactgactacgttggtaaacaaatcgaagaccttaaaacttactttggctcaggcgaagcgaaagaaatcgcaggtgcttactttgctttcaaaaatgaagctggtactaaatacatcactgaaaatggtgaagaagttgatactttggatacaacagatgccaaaggttgtgctgttcttaaaggtttaacaacagacaatggtttcaaatttaacacttctaaattaacaggaacttaccaaatcgttgaattgaaagaaaaatctacatacaacaacgatggttctatcttggctgattcaaaagcagttccagttaaaatcactcttccattggtaaacgacaatggtgttgttaaagacgctcacgtttatccaaagaacactgaaacaaaaccacaagtagataagaacttcgcagataaagaacttgattatgcgaacaacaaaaaagacaaagggactgtctcagcatctgttggtgatgttaaaaaataccatgttggaacaaaaatccttaaaggttcagactataagaaattaatctggaccgatagcatgaccaaaggtttgactttcaacaacgatattgctgtaacattggatggtgcaactcttgatgctacaaattacaaacttgtagcagatgaccaaggtttccgccttgtcttgactgacaaaggtcttgaagcagtggcaaaagccgcaaaaacaaaagatgttgaaatcaagatcacttactcagctactttgaacggttctgctgtcgttgaagttctagaaaccaatgatgttaaattggactacggcaacaacccaacaattgaaaatgaaccaaaagaaggtattccagttgataagaaaatcactgttaacaaaacatgggcagtagatggcaatgaagtgaataaagcagatgaaacagttgatgctgtcttcaccttgcaagttaaagatggtgacaaatgggtgaatgttgattcagctaaagcaacagctgcaactagcttcaaacacacttttgaaaacttggataatgctaaaacttaccgcgttatcgaacgtgttagcggctacgctccagaatacgtctcatttgtaaatggcgttgtaaccatcaagaacaacaaagactcaaatgagccaactccaatcaacccatcagaaccaaaagtggtgacttatggacgtaaatttgtgaaaacaaataaagatggaaaagaacgcttggcaggagctaccttccttgttaagaaagatggcaagtacttggcacgtaaatcaggtgttgcaacagatgcagaaaaagctgctgtagattcaactaaatcagcattggatgctgctgttaaagcttacaatgatttgactaaagaaaaacaagaaggtcaagatggtaaatcagcattggctaccgttagtgaaaaacaaaaagcttacaatgatgcctttgttaaagctaactactcatacgaatgggttgaagataaaaatgctaagaatgttgttaaattgatttctaacgataaaggtcaatttgaaattactggcttgactgaaggtcaatactcattggaagaaacacaagcaccaactggttatgctaaattatcaggtgatgtttcgtttaatgttaatgctacttcatacagtaaaggttctgctcaagatattgagtatacccaaggttctaaaactaaagatgcacaacaagttatcaataagaaggttactattccacaaacaggtggtattggtacaatttttttcacaattattggattaagtattatgcttggagcggtagttatcatgaaaagacgtcaatcagaggaagtttaa

SEQ ID NO: 163 - DNA, 2025 bp, Streptococcus agalactiae; identical to SEQ ID NO: 140

SEQ ID NO: 164 - DNA, 2025 bp, Streptococcus agalactiae; identical to SEQ ID NO: 140

SEQ ID NO: 165 - DNA, 2025 bp, Streptococcus agalactiae; identical to SEQ ID NO: 140

SEQ ID NO: 166 - DNA, 2025 bp, Streptococcus agalactiae; identical to SEQ ID NO: 140

SEQ ID NO: 167 - DNA, 2118 bp, Streptococcus agalactiae; identical to SEQ ID NO: 152

SEQ ID NO: 168 - DNA, 2025 bp, Streptococcus agalactiae; identical to SEQ ID NO: 140

SEQ ID NO: 169 - DNA, 2115 bp, Streptococcus agalactiae
atgaaaaaaatcaacaaatattttgcagtcttctcggccttgctactgaccgtaacatcattgctctcagttgcaccagcgtttgcggacgaagcaacaactaatacagtgactttgcacaagatcttgcaaactgaatcaaatcttaataaaagtaacttcccaggaactacaggccttaacggagatgactataaaggtgaatctatttctgaccttgctgaatactttggatcaggttctaaagaaattgacggtgctttctttgctttggctttagaagaggaaaaagatggtgtcgtacaatatgttaaggcaaaagcaaatgacaaattaacaccagacttaattactaaaggtacacctgcaacaacaacaaaagttgaagaagctgtaggtggtttgacaactggtacgggtattgttttcaatacagctggtttgaaaggtaatttcaaaattattgaattgaaagacaaatcaacttacaacaataatggttccctcttagcagcttcaaaagcagttccggtgaaaatcactcttccattggtaagcaaagatggtgttgttaaagatgcacacgtttatccaaagaacactgaaacaaaaccagaagtagacaagaacttcgctaaaacaaacgatttgacagctctcaaagacgctactcttcttaaggctggtgcagactacaaaaactattcagcgactaaagctactgtaacagctgaaatcggtaaagttatcccttacgaagttaaaacaaaagttcttaaaggttctaaatacgaaaaactggtttggaccgataccatgtcaaatggtttgacaatgggtgatgatgttaaccttgcagtttcagggactacaacaactttcattaaagatatagattacactcttagcattgatgaccgtggtttcacattgaaattcaaagctactggattggacaaattggaagaagcagctaaagcatctgatgttgaatttacattgacttataaagctactgttaatggccaagcaattattgacaacccagaagtcaatgacatcaaattggactatggtaataaacctggtacagatttatcagaacaacctgtgacacctgaagatggtgaagttaaagtcactaaaacatgggcagcaggtgctaataaagcagacgctaaagttgtctacacacttaaaaatgctactaaacaagtcgtagcttctgtcgcattgaccgcagctgatacaaaaggtacgattaatcttggtaaaggcatgacctttgaaatcacaggagctttctcaggtacattcaaaggccttcaaaataaagcttacactgtttctgaacgtgttgcaggttatactaatgctattaatgttactggtaatgctgttgctatcaccaatacaccagacagtgacaatccaacgccacttaacccaactcaaccaaaagttgaaacacatggtaagaaatttgtcaaagttggcgatgcagatgcccgcttagctggtgcacaattcgttgtgaaaaattcagctggtaaattccttgctcttaaagaagatgcagctgtatcaggagctcaaactgaattggcaactgctaaaacagacttggataatgccatcaaagcttacaacggtttgacaaaagcgcagcaagaaggtgctgatggtacatcagcaaaagaacttatcaacactaaacagtcagcttacgacgcagccttcatcaaagcacgtacagcttatacatgggtagatgaaaaaactaaagctattaccttcacttcaaataatcaaggtcaatttgaagttactggtcttgaagtaggttcttacaaacttgaagaaactcttgcaccagcaggttatgctaaattgtcaggcgacattgagtttacagttggacacgattcttacacaagtggtgacatcaagtacaagacagatgatgctagcaacaatgcacaaaaagttttcaataaaaaagtaaccatcccacaaacaggtggtattggtacaattcttttcacaattattggtttaagcattatgcttggagcggtagttatcatgaaaagacgtcaatcagaggaagcttaa

SEQ ID NO: 170 - DNA, 2025 bp, Streptococcus agalactiae; identical to SEQ ID NO: 140

SEQ ID NO: 171 - DNA, 2118 bp, Streptococcus agalactiae; identical to SEQ ID NO: 152

SEQ ID NO: 172 - DNA, 2025 bp, Streptococcus agalactiae; identical to SEQ ID NO: 140

SEQ ID NO: 173 - DNA, 2118 bp, Streptococcus agalactiae; identical to SEQ ID NO: 152

SEQ ID NO: 174 - DNA, 2025 bp, Streptococcus agalactiae; identical to SEQ ID NO: 140

SEQ ID NO: 175 - protein, 816 aa, Streptococcus agalactiae
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPDVKPDVKPEAKPEAKPEAKPEAKPEAKPEAKPEAKPEVKPDVKPEAKPDVKPEAKPDVKPEAKPEVKPDVKPEVKPEAKPEIKPDVKPEARPEAKPEVKPDVKPEAKPEVKPDVKPEAKPEAKPEVKPDVKPEAKPEAKPATKKSVNTSGNLAAKKAIENKKYSKKLPSTGEAASPLLAIVSLIVMLSAGLITIVLKHKKN

SEQ ID NO: 176 - protein, 800 aa, Streptococcus agalactiae
MNNNEKKVKYFLRKTAYGLASMSAAFAVCSGIVHADTSSGISDSIPHKKQVNLGAVTLKNLISKYRGNDKAIAILLSRVNDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELGKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPEAKPEAKPEAKPEVKPDVKPEAKPDVKPEAKPDVKPEVKPDVKPEAKPDVKPEAKPDVKPEVKPEAKPEAKPEAKPEIKPDVKPEARPEAKPEVKPDVKPEAKPEVKPEVKPDVKPEAKPEAKPATKKSVNTSGNLAVKKAIENKKYSKKLPSTGEAASPLLAIVSLIVMLSAGLITIVLKHKKN

SEQ ID NO: 177 - protein, 772 aa, Streptococcus agalactiae
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDIFAVQKAVDQAYDHVEEGKFITTDQANQLANKIRDALQSLELKDKKVAKPEGKPEVKPDVKPEAKPDVKPEAKPDVKPEVKPDVKPEAKPDVKPEAKPDVKPEVKPEAKPEVKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 178 - protein, 820 aa, Streptococcus agalactiae
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELGKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPDVKPDVKPEAKPEAKPEAKPEAKPEAKPEAKPEAKPEVKPDVKPEAKPDVKPEAKPDVKPEAKPEVKPDVKPEAKPDVKPEAKPDVKPEVKPEAKPEVKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 179 - protein, 643 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKYISSSKDSQLILKFVTQATQLNNAESTKAKQMAQNDVALIKNISPEVLEEYKEKIQRASTKSQVDEFVAEAKKVVNSNKETLVNQANGKKQEIDKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 180 - DNA, 2451 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggattcaattcctcataagaaacaagttaatttaggggcggttactctgaagaatttgatttctaaatatcgtggtaatgacaaagctattgctatacttctaagtagagtagatgattttaatagagcatcacaggatacacttccacaattaattaatagtactgaagcagaaattaacaatactttacctcagggacgaattattaaacagagtataccagtcgtaagattaaaagttgagagattgggaagtggtgcaattaaggctgagtcgattaataatattaaagctgaatcaattaataaaattcagggtaaatcaactaatacaattaaggctgagtccattaataaaattaaagtagagtctattaatacaatcaaagccgaatcaattaataaaattcaagctaagccaattaacacaatcaaagccgagtctattaatacaattaaggctgaatcaattcataaaattaaacctcaatcaataaaaagtactagtgctacacatgttaaagttagtgatcaagaactagctaagcagtcaagacgttctcaagatatcattaaatcattaggtttcctttcatcagaccaaaaagatattttagttaaatctattagctcttcaaaagattcgcaacttattcttaaatttgtaacacaagccacgcaactgaataatgctgaatcaacaaaagctaagcacatggctcaaaatgacgtggcttcaataaaaaatataagcctcgaagtcttagaagaatataaagaaaaaattcaaagagctagcactaagagtcaagttgatgagcttgtagcagaagctaaaaaagttgttaattccaataaagaaacattggtaaatcaggccaatggtaaaaagcaagaaattgctaagttagaaaatttatctaacgatgaaatgttgagatataatactgcaattgataatgtagtgaaacagtataatgaaggtaagctcaatattactgatgcaatgaatgctttaaatagtattaagcaagcagcacaggaagttgcccagaaaaacttacaaaagcagtatgctaaaaaaattgaaagaataagtttaaaaggattagcgttatccaaaaaggctaaagaaatttatgaaaagcataaaagtattttgcctacacctggatattatgcagactctgtgggaacttatttgaataggtttagagataaacgaactttcggaaatagaagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccaaatattcaagtacctaaacaagcacctacagaagctgcaaaaccagctttgtcaccagaagccttgacaagattgactacatggtataatcaagctaaagatctgcttaaagatgatcaagtaaaggacaaatatgtagatatacttgcagttcaaaaagctgttgaccaagcttatgatcatgtggaagagggaaaatttattaccactgatcaagcaaatcaattagctaacaagctacgtgatgctttacaaagtttagaattaaaagataaaaaagtagccaaaccagaagctaagccagaagttaaaccagaagccaaaccagatgttaagccagacgttaagccagaagctaagccagaagccaaaccagaggccaaaccagaagccaaaccagaggccaaaccagaagccaaaccagaggctaagccagaagttaaaccagacgttaagccagaggccaaaccagacgttaagccagaagccaaaccagacgttaagccagaggctaagccagaagttaaaccagacgttaagccagaagttaaaccagaggctaaaccagaaattaaaccagacgttaagccagaggccagaccagaggctaagccagaagttaaaccagacgttaagccagaggccaaaccagaagttaaaccagacgttaagccagaggccaaaccagaggctaagccagaagttaaaccagacgttaagccagaggctaaaccagaagccaaaccagcaaccaaaaaatcggttaatactagcggaaacttggcggctaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaattaa

SEQ ID NO: 181 - DNA, 2403 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggattcaattcctcataagaaacaagttaatttaggggcggttactctgaagaatttgatttctaaatatcgtggtaatgacaaagctattgctatacttttaagtagagtaaatgattttaatagagcatcacaggatacacttccacaattaattaatagtactgaagcagaaattaacaatactttacctcagggacgaattattaaacagagtataccagtcgtaagattaaaagttgagagattgggaagtggtgcaattaaggctgagtcgattaataatattaaagctgaatcaattaataaaattcagggtaaatcaactaatacaattaaggctgagtccattaataaaattaaagtagagtctattaatacaatcaaagccgaatcaattaataaaattcaagctaagccaattaacacaatcaaagccgagtctattaatacaattaaggctgaatcaattcataaaattaaacctcaatcaataaaaagtactagtgctacacatgttaaagttagtgatcaagaactaggtaagcagtcaagacgttctcaagatatcattaaatcattaggtttcctttcatcagaccaaaaagatattttagttaaatctattagctcttcaaaagattcgcaacttattcttaaatttgtaacacaagccacgcaactgaataatgctgaatcaacaaaagctaagcacatggctcaaaatgacgtggcttcaataaaaaatataagcctcgaagtcttagaagaatataaagaaaaaattcaaagagctagcactaagagtcaagttgatgagcttgtagcagaagctaaaaaagttgttaattccaataaagaaacattggtaaatcaggccaatggtaaaaagcaagaaattgctaagttagaaaatttatctaacgatgaaatgttgagatataatactgcaattgataatgtagtgaaacagtataatgaaggtaagctcaatattactgatgcaatgaatgctttaaatagtattaagcaagcagcacaggaagttgcccagaaaaacttacaaaagcagtatgctaaaaaaattgaaagaataagtttaaaaggattagcgttatccaaaaaggctaaagaaatttatgaaaagcataaaagtattttgcctacacctggatattatgcagactctgtgggaacttatttgaataggtttagagataaacgaactttcggaaatagaagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccaaatattcaagtacctaaacaagcacctacagaagctgcaaaaccagctttgtcaccagaagccttgacaagattgactacatggtataatcaagctaaagatctgcttaaagatgatcaagtaaaggacaaatatgtagatatacttgcagttcaaaaagctgttgaccaagcttatgatcatgtggaagagggaaaatttattaccactgatcaagcaaatcaattagctaacaagctacgtgatgctttacaaagtttagaattaaaagataaaaaagtagccaaaccagaagctaagccagaagttaaaccagaagccaaaccagaggccaaaccagaagccaaaccagaggctaagccagaagttaaaccagacgttaagccagaggccaaaccagacgttaagccagaagccaaaccagacgttaagccagaagttaaaccagacgttaagccagaggccaaaccagacgttaagccagaagctaagccagacgttaagccagaagttaaaccagaggctaagccagaagccaaaccagaggctaaaccagaaattaaaccagacgttaagccagaggccagaccagaggctaagccagaagttaaaccagacgttaagccagaggccaaaccagaggttaagccagaagttaaaccagacgttaagccagaggctaaaccagaagccaaaccagcaaccaaaaaatcggttaatactagcggaaacttggcggttaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaattaa

SEQ ID NO: 182 - DNA, 2319 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggattcaattcctcataagaaacaagttaatttaggggcggttactctgaagaatttgatttctaaatatcgtggtaatgacaaagctattgctatacttctaagtagagtagatgattttaatagagcatcacaggatacacttccacaattaattaatagtactgaagcagaaattaacaatactttacctcagggacgaattattaaacagagtataccagtcgtaagattaaaagttgagagattgggaagtggtgcaattaaggctgagtcgattaataatattaaagctgaatcaattaataaaattcagggtaaatcaactaatacaattaaggctgagtccattaataaaattaaagtagagtctattaatacaatcaaagccgaatcaattaataaaattcaagctaagccaattaacacaatcaaagccgagtctattaatacaattaaggctgaatcaattcataaaattaaacctcaatcaataaaaagtactagtgctacacatgttaaagttagtgatcaagaactagctaagcagtcaagacgttctcaagatatcattaaatcattaggtttcctttcatcagaccaaaaagatattttagttaaatctattagctcttcaaaagattcgcaacttattcttaaatttgtaacacaagccacgcaactgaataatgctgaatcaacaaaagctaagcacatggctcaaaatgacgtggcttcaataaaaaatataagcctcgaagtcttagaagaatataaagaaaaaattcaaagagctagcactaagagtcaagttgatgagcttgtagcagaagctaaaaaagttgttaattccaataaagaaacattggtaaatcaggccaatggtaaaaagcaagaaattgctaagttagaaaatttatctaacgatgaaatgttgagatataatactgcaattgataatgtagtgaaacagtataatgaaggtaagctcaatattactgatgcaatgaatgctttaaatagtattaagcaagcagcacaggaagttgcccagaaaaacttacaaaagcagtatgctaaaaaaattgaaagaataagtttaaaaggattagcgttatccaaaaaggctaaagaaatttatgaaaagcataaaagtattttgcctacacctggatattatgcagactctgtgggaacttatttgaataggtttagagataaacgaactttcggaaatagaagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccaaatattcaagtacctaaacaagcacctacagaagctgcaaaaccagctttgtcaccagaagccttgacaagattgactacatggtataatcaagctaaagatctgcttaaagatgatcaagtaaaggacaaatatgtagatatatttgcagttcaaaaagctgttgaccaagcttatgatcatgtggaagagggaaaatttattaccactgatcaagcaaatcaattagctaacaagatacgtgatgctttacaaagtttagaattaaaagataaaaaagtagccaaaccagagggtaagccagaagttaaaccagacgttaagccagaggccaaaccagacgttaagccagaagccaaaccagacgttaagccagaagttaaaccagacgttaagccagaggccaaaccagacgttaagccagaagctaagccagacgttaagccagaagttaaaccagaggctaagccagaagttaaaccagacgttaagccagaggccagaccagaggctaagccagaagttaaaccagacgttaagccagaggccaaaccagaggctaagccagaagttaaaccagacgttaagccagaggctaaaccagaagccaaaccagcaaccaaaaaatcggttaatactagcggaaacttggcggttaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaattaa

SEQ ID NO: 183 - DNA, 2463 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggattcaattcctcataagaaacaagttaatttaggggcggttactctgaagaatttgatttctaaatatcgtggtaatgacaaagctattgctatacttctaagtagagtagatgattttaatagagcatcacaggatacacttccacaattaattaatagtactgaagcagaaattaacaatactttacctcagggacgaattattaaacagagtataccagtcgtaagattaaaagttgagagattgggaagtggtgcaattaaggctgagtcgattaataatattaaagctgaatcaattaataaaattcagggtaaatcaactaatacaattaaggctgagtccattaataaaattaaagtagagtctattaatacaatcaaagccgaatcaattaataaaattcaagctaagccaattaacacaatcaaagccgagtctattaatacaattaaggctgaatcaattcataaaattaaacctcaatcaataaaaagtactagtgctacacatgttaaagttagtgatcaagaactaggtaagcagtcaagacgttctcaagatatcattaaatcattaggtttcctttcatcagaccaaaaagatattttagttaaatctattagctcttcaaaagattcgcaacttattcttaaatttgtaacacaagccacgcaactgaataatgctgaatcaacaaaagctaagcacatggctcaaaatgacgtggcttcaataaaaaatataagcctcgaagtcttagaagaatataaagaaaaaattcaaagagctagcactaagagtcaagttgatgagcttgtagcagaagctaaaaaagttgttaattccaataaagaaacattggtaaatcaggccaatggtaaaaagcaagaaattgctaagttagaaaatttatctaacgatgaaatgttgagatataatactgcaattgataatgtagtgaaacagtataatgaaggtaagctcaatattactgatgcaatgaatgctttaaatagtattaagcaagcagcacaggaagttgcccagaaaaacttacaaaagcagtatgctaaaaaaattgaaagaataagtttaaaaggattagcgttatccaaaaaggctaaagaaatttatgaaaagcataaaagtattttgcctacacctggatattatgcagactctgtgggaacttatttgaataggtttagagataaacgaactttcggaaatagaagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccaaatattcaagtacctaaacaagcacctacagaagctgcaaaaccagctttgtcaccagaagccttgacaagattgactacatggtataatcaagctaaagatctgcttaaagatgatcaagtaaaggacaaatatgtagatatacttgcagttcaaaaagctgttgaccaagcttatgatcatgtggaagagggaaaatttattaccactgatcaagcaaatcaattagctaacaagctacgtgatgctttacaaagtttagaattaaaagataaaaaagtagccaaaccagaagctaagccagaagttaaaccagaagccaaaccagatgttaagccagacgttaagccagaagctaagccagaagccaaaccagaggccaaaccagaagccaaaccagaggccaaaccagaagccaaaccagaggctaagccagaagttaaaccagacgttaagccagaggccaaaccagacgttaagccagaagccaaaccagacgttaagccagaggctaagccagaagttaaaccagacgttaagccagaggccaaaccagacgttaagccagaagctaagccagacgttaagccagaagttaaaccagaggctaagccagaagttaaaccagacgttaagccagaggccagaccagaggctaagccagaagttaaaccagacgttaagccagaggccaaaccagaggctaagccagaagttaaaccagacgttaagccagaggctaaaccagaagctaaaccagcaaccaaaaaatcggttaatactagcggaaacttggcggttaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaattaa

SEQ ID NO: 184 - DNA, 1932 bp, Streptococcus agalactiae
atgaataataacgaaaaaaaagtaaaatactttttaagaaaaacagcttatggtttggcctcaatgtcagcagcgtttgctgtatgtagtggtattgtacacgcggatactagttcaggaatatcggcttcaattcctcataagaaacaagttaatttaggggcggttactctgaagaatttgatttctaaatatcgtggtaatgacaaagctattgctatacttttaagtagagtaaatgattttaatagagcatcacaggatacacttccacaattaattaatagtactgaagcagaaattagaaatattttatatcaaggacaaattggtaagcaaaataaaccaagtgtaactacacatgctaaagttagtgatcaagaactaggtaagcagtcaagacgttctcaagatatcattaagtcattaggtttcctttcatcagaccaaaaagatattttagttaaatatattagctcttcaaaagattcgcaacttattcttaaatttgtaactcaagccacgcaactgaataatgctgaatcaacaaaagctaagcaaatggctcaaaatgacgtggccttaataaaaaatataagccccgaagtcttagaagaatataaagaaaaaattcaaagagctagcactaagagtcaagttgatgagtttgtagcagaagctaaaaaagttgttaattccaataaagaaacgttggtaaatcaggccaatggtaaaaagcaagaaattgataagttagaaaatttatctaacgatgaaatgttgagatataatactgcaattgataatgtagtgaaacagtataatgaaggtaagctcaatattactgctgcaatgaatgctttaaatagtattaagcaagcagcacaggaagttgcccagaaaaacttacaaaagcagtatgctaaaaaaattgaaagaataagttcaaaaggattagcgttatctaaaaaggctaaagaaatttatgaaaagcataaaagtattttgcctacacctggatattatgcagactctgtgggaacttatttgaataggtttagagataaacaaactttcggaaataggagtgtttggactggtcaaagtggacttgatgaagcaaaaaaaatgcttgatgaagtcaaaaagcttttaaaagaacttcaagaccttaccagaggtactaaagaagataaaaaaccagacgttaagccagaagccaaaccagaggccaaaccaaatattcaagtacctaaacaagcacctacagaagctgcaaaaccagctttgtcaccagaagccttgacaagattgactacatggtataatcaagctaaagatctgcttaaagatgatcaagtaaaggacaaatacgtagatatacttgcagttcaaaaagctgttgaccaagcttatgatcatgtggaagagggaaaatttattaccactgatcaagcaaatcaattagctaacaagctacgtgatgctttacaaagtttagaattaaaagataaaaaagtagccaaaccagaagccaaaccagaggccaaaccagaagctaagccagaagctaagccagaagctaagccagaagctaagccagaggccaaaccagaagctaagccagacgttaagccagaagctaaaccagacgttaaaccagaggctaagccagaagctaaaccagaggctaagtcagaagctaaaccagaggctaagctagaagctaaaccagaggccaaaccagcaaccaaaaaatcggttaatactagcggaaacttggcggctaaaaaagctattgaaaacaaaaagtatagtaaaaaattaccatcaacgggtgaagccgcaagtccactcttagcaattgtatcactaattgttatgttaagtgcaggtcttattacgatagttttaaagcataaaaaaaattaa

SEQ ID NO: 185 - protein, 896 aa, Streptococcus agalactiae
MRKYQKFSKILTLSLFCLSQIPLNTNVLGESTVPENGAKGKLVVKKTDDQNKPLSKATFVLKPTSHSESKVEKVTTEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVKGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLHLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKRHKKSSDASIEKD

SEQ ID NO: 186 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTFYRNGPVREHGTPTKLYINSLKQKNYDIFNFGIDISGFRQVYNEDYKKNQDGTFQKLKEEAFELSDGEITELMKSFSSKPEYYTPIVTSSDASNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 187 - protein, 890 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 188 - protein, 896 aa, Streptococcus agalactiae
MRKYQKFSKILTLSLFCLSQIPLNTNVLGESTVPENGAKGKLVVKKTDDQNKPLSKATFVLKTTAHPESKIEKVTAEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSDGEITELMNSFSSKPEYYTPIVTSADVSNNEILSKIQQQFEKILTKENSIVNGTIEDPMGDKINLHLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKRHKKSSDASIEKD

SEQ ID NO: 189 - protein, 890 aa, Streptococcus agalactiae; identical to SEQ ID NO: 187

SEQ ID NO: 190 - protein, 890 aa, Streptococcus agalactiae; identical to SEQ ID NO: 187

SEQ ID NO: 191 - protein, 890 aa, Streptococcus agalactiae; identical to SEQ ID NO: 187

SEQ ID NO: 192 - protein, 890 aa, Streptococcus agalactiae; identical to SEQ ID NO: 187

SEQ ID NO: 193 - protein, 890 aa, Streptococcus agalactiae
MKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKNTGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 194 - protein, 890 aa, Streptococcus agalactiae; identical to SEQ ID NO: 187

SEQ ID NO: 195 - protein, 901 aa, Streptococcus agalactiae
MRKYQKFSKILTLSLFCLSQIPLNTNVLGESTVPENGAKGKLVVKKTDDQNKPLSKATFVLKTTAQPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTFYRNGPVREHGTPTKLYINSLKQKNYDIFNFGIDISGFRQVYNEDYKKNQDGTFQKLKEEAFELSDGEITELMKSFSSKPEYYTPIVTSSDASNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 196 - protein, 890 aa, Streptococcus agalactiae; identical to SEQ ID NO: 187

SEQ ID NO: 197 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNHEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPRAKWGSTTNGLTPEQQKQYYLSKVGETFTMKAFMEADDILSQVDRNSQKIIVHITDGVPTRSYAINNFKLGASYESQFEQMKKNGYLNKSNFLLTDKPEDIKGNGESYFLFPLDSYQTQIISGNLQKLHYLDLNLNYPKGTIYRNGPVREHGTPTKLYINSLKQKNYDIFNFGIDISAFRQVYNEDYKKNQDGTFQKLKEEAFELSDGEITELMKSFSSKPEYYTPIVTSSDASNNEILSKIQQQFEKVLTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEDPNTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGSMMSIAGGIYIWKRYKKSSDISREKD

SEQ ID NO: 198 - protein, 896 aa, Streptococcus agalactiae; identical to SEQ ID NO: 185

SEQ ID NO: 199 - protein, 901 aa, Streptococcus agalactiae; identical to SEQ ID NO: 186

SEQ ID NO: 200 - protein, 901 aa, Streptococcus agalactiae; identical to SEQ ID NO: 195

SEQ ID NO: 201 - protein, 901 aa, Streptococcus agalactiae; identical to SEQ ID NO: 186

SEQ ID NO: 202 - protein, 901 aa, Streptococcus agalactiae; identical to SEQ ID NO: 186

SEQ ID NO: 203 - protein, 896 aa, Streptococcus agalactiae
MRKYQKFSKILTLSLFCLSQIPLNTNVLGESTVPENGAKGKLVVKKTDDQNKPLSKATFVLKTTAHPESKIEKVTAEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYHGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYNEDYKKNQDGTFQKLKEEAFELSGGEITELMKSFSSKPEYYTPIVTSADVSNNEILSKIQQQFEKILTKENSIVNGTIEDPMGDKINLQLGNGQTLQPSDYTLQGNDGSIMKDSIATGGPNNDGGILKGVKLEYIKNKLYVRGLNLGEGQKVTLTYDVKLDDSFISNKFYDTNGRTTLNPKSEEPDTLRDFPIPKIRDVREYPTITIKNEKKLGEIEFTKVDKDNNKLLLKGATFELQEFNEDYKLYLPIKNNNSKVVTGENGKISYKDLKDGKYQLIEAVSPKDYQKITNKPILTFEVVKGSIQNIIAVNKQISEYHEEGDKHLITNTHIPPKGIIPMTGGKGILSFILIGGAMMSIAGGIYIWKKHKKSSDASIEKD

SEQ ID NO: 204 - DNA, 2691 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaacctacttcacactcagaaagcaaagtagaaaaagtaactactgaggtaacaggtgaagctacttttgataatctcacacctggagattacactttatcagaagaaacggcacccgaaggatacaaaaagactacccagacttggcaagttaaggttgagagtaatggaaaaactacgatacaaaatagtgatgataaaaaatctataattgaacaaaggcaagaggaactagataagcagtatccccttacaggagcttatgaagatacaaaagaatcttataatcttgagcatgttaaaaattcaattccaaatgggaaattagaggcaaaagcagttaatccatattcaagtgaaggtgagcacataagagaaattcaagagggaacattatctaaacgtatttcagaagtaaatgatttggatcataataaatataaaattgagttaactgttagcggtaaatccataataaaaactataaataaagatgaacctctggatgttgtttttgttcttgataattcaaattctatgaagaataatggaaaaaataacaaggcaaaaaaggcaggtgaagcagtagaaacaattataaaagatgttttaggagcaaatgttgaaaaccgagcagctttagttacttatggttcagatatttttgatggaaggacagttaaagttataaaaggttttaaagaggatccttattatggacttgaaactagtttcacagttcagacaaatgattatagctataaaaagttcactaatattgctgctgatattataaaaaagatccctaaagaagctccagaagctaagtggggggggacaagtctaggattaactccagaaaaaaagagggaatatgatttaagtaaagtaggtgagacctttacaatgaaagcttttatggaggcagataccttgttaagtagtatacagcgtaagagtagaaagattattgttcatctaactgacggtgttccaacaagatcatatgccattaatagttttgtaaaaggttcaacatacgcaaatcaatttgagagaataaaagaaaaaggttatttagacaaaaataattattttataactgatgatccagaaaagatcaaaggcaatggggagagttactttttgtttcccttagatagttatcaaacacagataatttctggaaacttacaaaaacttcattatttagatttaaatcttaattaccctaaaggtacaatttatagaaatggaccagtaagagaacatggaacaccaaccaaactttatataaatagtttaaaacagaaaaattatgacatctttaattttggtatagatatatctggttttagacaagtttataatgaggattataagaaaaatcaagatggtacttttcaaaaattgaaggaggaagcttttgaactttcagatggggaaataacagaactaatgaattcattctcttctaaacctgagtattataccccgatagtaacttcagctgatgtatctaataatgaaattttatctaaaattcagcaacaatttgaaaagattttaacaaaggaaaactcaattgttaatggaactatagaagatcctatgggtgataaaatcaatttacatcttggcaacggacaaacattgcaaccaagtgattatactttacagggaaatgatggaagtataatgaaagatagcattgcaactggagggcctaataatgatggtgggatacttaaaggggttaaattagaatacatcaaaaataaactctacgttagaggtttgaacttaggggaggggcaaaaagtaacactcacatatgatgtgaaactagatgacagttttattagtaacaaattctatgacactaatggtagaacaacattgaatcctaaatcagaggaacccgatacacttagagattttccaatccctaaaattcgtgatgtgagagaatatcctacaataacgattaaaaacgagaagaagttaggtgaaattgaatttacaaaagttgataaagataataataagttgcttctcaaaggagctacatttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccgaaggattatcaaaaaattactaataaaccaattttaacttttgaagttgttaaaggatcgatacaaaatataatagctgttaataaacagatttctgaatatcatgaggaaggtgacaagcatttaattaccaacacgcatattccaccaaaaggaattattccgatgacaggtgggaaaggaattctatctttcattttaataggtggagctatgatgtctattgcaggtggaatttatatttggaaaagacataagaaatctagtgatgcatcaatcgagaaagattaa

SEQ ID NO: 205 - DNA, 2706 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgagctaacaggtgaagctacttttgataatctcatacctggagattatactttatcagaagaaacagcgcccgaaggttataaaaagactaaccagacttggcaagttaaggttgagagtaatggaaaaactacgatacaaaatagtggtgataaaaattccacaattggacaaaatcaggaagaactagataagcagtatccccccacaggaatttatgaagatacaaaggaatcttataaacttgagcatgttaaaggttcagttccaaatggaaagtcagaggcaaaagcagttaacccatattcaagtgaaggtgagcatataagagaaattccagagggaacattatctaaacgtatttcagaagtaggtgatttagctcataataaatataaaattgagttaactgtcagtggaaaaaccatagtaaaaccagtggacaaacaaaagccgttagatgttgtcttcgtactcgataattctaactcaatgaataacgatggcccaaattttcaaaggcataataaagccaagaaagctgccgaagctcttgggaccgcagtaaaagatattttaggagcaaacagtgataatagggttgcattagttacctatggttcagatatttttgatggtaggagtgtagatgtcgtaaaaggatttaaagaagatgataaatattatggccttcaaactaagttcacaattcagacagagaattatagtcataaacaattaacaaataatgctgaagagattataaaaaggattccgacagaagctcctaaagctaagtggggatctactaccaatggattaactccagagcaacaaaaggagtactatcttagtaaagtaggagaaacatttactatgaaagccttcatggaggcagatgatattttgagtcaagtaaatcgaaatagtcaaaaaattattgttcatgtaactgatggtgttcctacgagatcatatgctattaataattttaaactgggtgcatcatatgaaagccaatttgaacaaatgaaaaaaaatggatatctaaataaaagtaattttctacttactgataagcccgaggatataaaaggaaatggggagagttactttttgtttcccttagatagttatcaaacacagataatctctggaaacttacaaaaacttcattatttagatttaaatcttaattaccctaaaggtacattttatcgaaatggaccagtaagagaacatggaacaccaaccaaactttatataaatagtttaaaacagaaaaattatgacatctttaattttggtatagatatatctggttttagacaagtttataatgaggattataagaaaaatcaagatggtacttttcaaaaattgaaagaggaagcttttgaactttcagatggggaaataacagaactaatgaagtcattctcttctaaacctgagtattataccccgatagtaacttcatccgatgcatctaacaatgaaattttatctaaaattcagcaacaatttgaaaagattttaacaaaagaaaactcaattgttaatggaactatagaagatcctatgggtgacaaaatcaatttacagcttggcaacggacaaacattgcaaccaagtgattatactttacagggaaatgatggaagtataatgaaagatagcattgcaactggtgggcctaataatgatggtggaatacttaaaggggttaaattagaatacatcaaaaataaactctacgttagaggtttgaacttaggggagggacaaaaagtaacactcacatatgatgtgaaactagatgacagttttataagtaacaaattctatgacactaatggtagaacaacattgaatcctaaatcagaggatcctaatacacttagagattttccaatccctaaaattcgtgatgtgagagaatatcctacaataacgattaaaaacgagaagaagttaggtgaaattgaatttacaaaagttgataaagataataataagttgcttctcaaaggagctacgtttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccgaaggattatcaaaaaattactaataaaccaattttaacttttgaagttgttaaaggatcgatacaaaatataatagctgttaataaacagatttctgaatatcatgaggaaggtgacaagcatttaattaccaacacgcatattccaccaaaaggaattattccgatgacaggtgggaaaggaattctatctttcattttaataggtggatctatgatgtctattgcaggtggaatttatatttggaaaagatataagaaatctagtgatatatctagagaaaaagattaa

SEQ ID NO: 206 - DNA, 2673 bp, Streptococcus agalactiae
atgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaa

SEQ ID NO: 207 - DNA, 2691 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgaggtaacaggtgaagctacttttgataatctcacacctggagattacactttatcagaagaaacggcacccgaaggatacaaaaagactacccagacttggcaagttaaggttgagagtaatggaaaaactacgatacaaaatagtgatgataaaaaatctataattgaacaaaggcaagaggaactagataagcagtatccccttacaggagcttatgaagatacaaaagaatcttataatcttgagcatgttaaaaattcaattccaaatgggaaattagaggcaaaagcagttaatccatattcaagtgaaggtgagcacataagagaaattcaagagggaacattatctaaacgtatttcagaagtaaatgatttggatcataataaatataaaattgagttaactgttagcggtaaatccataataaaaactataaataaagatgaacctctggatgttgtttttgttcttgataattcaaattctatgaagaataatggaaaaaataacaaggcaaaaaaggcaggtgaagcagtagaaacaattataaaagatgttttaggagcaaatgttgaaaaccgagcagctttagttacttatggttcagatatttttgatggaaggacagttaaagttataaaaggttttaaagaggatccttattatggacttgaaactagtttcacagttcagacaaatgattatagctataaaaagttcactaatattgctgctgatattataaaaaagatccctaaagaagctccagaagctaagtggggggggacaagtctaggattaactccagaaaaaaagagggaatatgatttaagtaaagtaggtgagacctttacaatgaaagcttttatggaggcagataccttgttaagtagtatacagcgtaagagtagaaagattattgttcatctaactgacggtgttccaacaagatcatatgccattaatagttttgtaacaggttcaacatacgcaaatcaatttgagagaataaaagaaaaaggttatttagacaaaaataattattttataactgatgatccagaaaagatcaaaggcaatggggagagttactttttgtttcccttagatagttatcaaacacagataatttctggaaacttacaaaaacttcattatttagatttaaatcttaattaccctaaaggtacaatttatagaaatggaccagtaagagaacatggaacaccaaccaaactttatataaatagtttaaaacagaaaaattatgacatctttaattttggtatagatatatctggttttagacaagtttataatgaggattataagaaaaatcaagatggtacttttcaaaaattgaaggaggaagcttttgaactttcagatggggaaataacagaactaatgaattcattctcttctaaacctgagtattataccccgatagtaacttcagctgatgtatctaataatgaaattttatctaaaattcagcaacaatttgaaaagattttaacaaaggaaaactcaattgttaatggaactatagaagatcctatgggtgataaaatcaatttacatcttggcaacggacaaacattgcaaccaagtgattatactttacagggaaatgatggaagtataatgaaagatagcattgcaactggagggcctaataatgatggtgggatacttaaaggggttaaattagaatacatcaaaaataaactctacgttagaggtttgaacttaggggaggggcaaaaagtaacactcacatatgatgtgaaactagatgacagttttattagtaacaaattctatgacactaatggtagaacaacattgaatcctaaatcagaggaacccgatacacttagagattttccaatccctaaaattcgtgatgtgagagaatatcctacaataacgattaaaaacgagaagaagttaggtgaaattgaatttacaaaagttgataaagataataataagttgcttctcaaaggagctacatttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccgaaggattatcaaaaaattactaataaaccaattttaacttttgaagttgttaaaggatcgatacaaaatataatagctgttaataaacagatttctgaatatcatgaggaaggtgacaagcatttaattaccaacacgcatattccaccaaaaggaattattccgatgacaggtgggaaaggaattctatctttcattttaataggtggagctatgatgtctattgcaggtggaatttatatttggaaaagacataagaaatctagtgatgcatcaatcgagaaagattaa

SEQ ID NO: 208 - DNA, 2673 bp, Streptococcus agalactiae; identical to SEQ ID NO: 206

SEQ ID NO: 209 - DNA, 2673 bp, Streptococcus agalactiae; identical to SEQ ID NO: 206

SEQ ID NO: 210 - DNA, 2673 bp, Streptococcus agalactiae; identical to SEQ ID NO: 206

SEQ ID NO: 211 - DNA, 2673 bp, Streptococcus agalactiae; identical to SEQ ID NO: 206

SEQ ID NO: 212 - DNA, 2673 bp, Streptococcus agalactiae
atgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaaatacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaa

SEQ ID NO: 213 - DNA, 2673 bp, Streptococcus agalactiae; identical to SEQ ID NO: 206

SEQ ID NO: 214 - DNA, 2706 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcaaccagaaagtaaaatagaaaaagtaactgctgagctaacaggtgaagctacttttgataatctcatacctggagattatactttatcagaagaaacagcgcccgaaggttataaaaagactaaccagacttggcaagttaaggttgagagtaatggaaaaactacgatacaaaatagtggtgataaaaattccacaattggacaaaatcaggaagaactagataagcagtatccccccacaggaatttatgaagatacaaaggaatcttataaacttgagcatgttaaaggttcagttccaaatggaaagtcagaggcaaaagcagttaacccatattcaagtgaaggtgagcatataagagaaattccagagggaacattatctaaacgtatttcagaagtaggtgatttagctcataataaatataaaattgagttaactgtcagtggaaaaaccatagtaaaaccagtggacaaacaaaagccgttagatgttgtcttcgtactcgataattctaactcaatgaataacgatggcccaaattttcaaaggcataataaagccaagaaagctgccgaagctcttgggaccgcagtaaaagatattttaggagcaaacagtgataatagggttgcattagttacctatggttcagatatttttgatggtaggagtgtagatgtcgtaaaaggatttaaagaagatgataaatattatggccttcaaactaagttcacaattcagacagagaattatagtcataaacaattaacaaataatgctgaagagattataaaaaggattccgacagaagctcctaaagctaagtggggatctactaccaatggattaactccagagcaacaaaaggagtactatcttagtaaagtaggagaaacatttactatgaaagccttcatggaggcagatgatattttgagtcaagtaaatcgaaatagtcaaaaaattattgttcatgtaactgatggtgttcctacgagatcatatgctattaataattttaaactgggtgcatcatatgaaagccaatttgaacaaatgaaaaaaaatggatatctaaataaaagtaattttctacttactgataagcccgaggatataaaaggaaatggggagagttactttttgtttcccttagatagttatcaaacacagataatctctggaaacttacaaaaacttcattatttagatttaaatcttaattaccctaaaggtacattttatcgaaatggaccagtaagagaacatggaacaccaaccaaactttatataaatagtttaaaacagaaaaattatgacatctttaattttggtatagatatatctggttttagacaagtttataatgaggattataagaaaaatcaagatggtacttttcaaaaattgaaagaggaagcttttgaactttcagatggggaaataacagaactaatgaagtcattctcttctaaacctgagtattataccccgatagtaacttcatccgatgcatctaacaatgaaattttatctaaaattcagcaacaatttgaaaagattttaacaaaagaaaactcaattgttaatggaactatagaagatcctatgggtgacaaaatcaatttacagcttggcaacggacaaacattgcaaccaagtgattatactttacagggaaatgatggaagtataatgaaagatagcattgcaactggtgggcctaataatgatggtggaatacttaaaggggttaaattagaatacatcaaaaataaactctacgttagaggtttgaacttaggggagggacaaaaagtaacactcacatatgatgtgaaactagatgacagttttataagtaacaaattctatgacactaatggtagaacaacattgaatcctaaatcagaggatcctaatacacttagagattttccaatccctaaaattcgtgatgtgagagaatatcctacaataacgattaaaaacgagaagaagttaggtgaaattgaatttacaaaagttgataaagataataataagttgcttctcaaaggagctacgtttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccgaaggattatcaaaaaattactaataaaccaattttaacttttgaagttgttaaaggatcgatacaaaatataatagctgttaataaacagatttctgaatatcatgaggaaggtgacaagcatttaattaccaacacgcatattccaccaaaaggaattattccgatgacaggtgggaaaggaattctatctttcattttaataggtggatctatgatgtctattgcaggtggaatttatatttggaaaagatataagaaatctagtgatatatctagagaaaaagattaa

SEQ ID NO: 215 - DNA, 2673 bp, Streptococcus agalactiae; identical to SEQ ID NO: 206

SEQ ID NO: 216 - DNA, 2706 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgagctaacaggtgaagctacttttgataatctcatacctggagattatactttatcagaagaaacagcgcccgaaggttataaaaagactaaccagacttggcaagttaaggttgagagtaatggaaaaactacgatacaaaatagtggtgataaaaattccacaattggacaaaatcacgaagaactagataagcagtatccccccacaggaatttatgaagatacaaaggaatcttataaacttgagcatgttaaaggttcagttccaaatggaaagtcagaggcaaaagcagttaacccatattcaagtgaaggtgagcatataagagaaattccagagggaacattatctaaacgtatttcagaagtaggtgatttagctcataataaatataaaattgagttaactgtcagtggaaaaaccatagtaaaaccagtggacaaacaaaagccgttagatgttgtcttcgtactcgataattctaactcaatgaataacgatggcccaaattttcaaaggcataataaagccaagaaagctgccgaagctcttgggaccgcagtaaaagatattttaggagcaaacagtgataatagggttgcattagttacctatggttcagatatttttgatggtaggagtgtagatgtcgtaaaaggatttaaagaagatgataaatattatggccttcaaactaagttcacaattcagacagagaattatagtcataaacaattaacaaataatgctgaagagattataaaaaggattcctacagaagctcctagagctaaatggggatcaactacaaacggacttactccagagcaacaaaagcagtactatcttagtaaagtaggggaaacatttactatgaaagccttcatggaggcagatgatattttgagtcaagtagatcgaaatagtcaaaaaattattgttcatataactgatggtgttccaacaagatcatatgctattaataattttaaattgggtgcatcatatgaaagccaatttgaacaaatgaaaaaaaatggatatctaaataaaagtaattttctacttactgataagcccgaggatataaaaggaaatggggagagttactttttgtttcccttagatagttatcaaacacagataatctctggaaacttacaaaaacttcattatttagatttaaatcttaattaccctaaaggtacaatttatcgaaatggaccagtaagagaacatggaacaccaaccaaactttatataaatagtttaaaacagaaaaattatgacatctttaattttggtatagatatatctgcttttagacaagtttataatgaggattataagaaaaatcaagatggtacttttcaaaaattgaaagaggaagcttttgaactttcagatggggaaataacagaactaatgaagtcattctcttctaaacctgagtattataccccgatagtaacttcatccgatgcatctaacaatgaaattttatctaaaattcagcaacaatttgaaaaggttttaacaaaagaaaactcaattgttaatggaactatagaagatcctatgggtgacaaaatcaatttacagcttggcaacggacaaacattgcaaccaagtgattatactttacagggaaatgatggaagtataatgaaagatagcattgcaactggtgggcctaataatgatggtggaatacttaaaggggttaaattagaatacatcaaaaataaactctacgttagaggtttgaacttaggggagggacaaaaagtaacactcacatatgatgtgaaactagatgacagttttataagtaacaaattctatgacactaatggtagaacaacattgaatcctaaatcagaggatcctaatacacttagagattttccaatccctaaaattcgtgatgtgagagaatatcctacaataacgattaaaaacgagaagaagttaggtgaaattgaatttacaaaagttgataaagataataataagttgcttctcaaaggagctacgtttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccgaaggattatcaaaaaattactaataaaccaattttaacttttgaagttgttaaaggatcgatacaaaatataatagctgttaataaacagatttctgaatatcatgaggaaggtgacaagcatttaattaccaacacgcatattccaccaaaaggaattattccgatgacaggtgggaaaggaattctatctttcattttaataggtggatctatgatgtctattgcaggtggaatttatatttggaaaagatataagaaatctagtgatatatctagagaaaaagattaa

SEQ ID NO: 217 - DNA, 2691 bp, Streptococcus agalactiae; identical to SEQ ID NO: 204

SEQ ID NO: 218 - DNA, 2706 bp, Streptococcus agalactiae; identical to SEQ ID NO: 205

SEQ ID NO: 219 - DNA, 2706 bp, Streptococcus agalactiae; identical to SEQ ID NO: 214

SEQ ID NO: 220 - DNA, 2706 bp, Streptococcus agalactiae; identical to SEQ ID NO: 205

SEQ ID NO: 221 - DNA, 2706 bp, Streptococcus agalactiae; identical to SEQ ID NO: 205

SEQ ID NO: 222 - DNA, 2691 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgaggtaacaggtgaagctacttttgataatctcacacctggagattacactttatcagaagaaacggcacccgaaggatacaaaaagactacccagacttggcaagttaaggttgagagtaatggaaaaactacgatacaaaatagtgatgataaaaaatctataattgaacaaaggcaagaggaactagataagcagtatccccttacaggagcttatgaagatacaaaagaatcttataatcttgagcatgttaaaaattcaattccaaatgggaaattagaggcaaaagcagttaatccatattcaagtgaaggtgagcacataagagaaattcaagagggaacattatctaaacgtatttcagaagtaaatgatttggatcataataaatataaaattgagttaactgttagcggtaaatccataataaaaactataaataaagatgaacctctggatgttgtttttgttcttgataattcaaattctatgaagaataatggaaaaaataacaaggcaaaaaaggcaggtgaagcagtagaaacaattataaaagatgttttaggagcaaatgttgaaaaccgagcagctttagttacttatggttcagatatttttgatggaaggacagttaaagttataaaaggttttaaagaggatccttatcatggacttgaaactagtttcacagttcagacaaatgattatagctataaaaagttcactaatattgctgctgatattataaaaaagatccctaaagaagctccagaagctaagtggggggggacaagtctaggattaactccagaaaaaaagagggaatatgatttaagtaaagtaggtgagacctttacaatgaaagcttttatggaggcagataccttgttaagtagtatacagcgtaagagtagaaagattattgttcatctaactgacggtgttccaacaagatcatatgctattaatagttttgtaacaggttcaacatacgcaaatcaatttgagagaataaaagaaaaaggttatttagacaaaaataattattttataactgatgatccagaaaagatcaaaggcaatggggagagttactttttgtttcccttagatagttatcaaacacagataatttctggaaacttacaaaaacttcattatttagatttaaatcttaattaccctaaaggtacaatttatagaaatggaccagtaagagaacatggaacaccaaccaaactttatataaatagtttaaaacagaaaaattatgacatctttaattttggtatagatatatctggttttagacaagtttataatgaggattataagaaaaatcaagatggtacttttcaaaaattgaaagaggaagcttttgaactttcaggtggggaaataacagaactaatgaagtcattctcttctaaacctgagtattataccccgatagtaacttcagctgatgtatctaataatgaaattttatctaaaattcagcaacaatttgaaaagattttaacaaaggaaaactcaattgttaatggaactatagaagatcctatgggtgataaaatcaatttacagcttggcaacggacaaacattgcaaccaagtgattatactttacagggaaatgatggaagtataatgaaagatagcattgcaactggtgggcctaataatgatggcgggatacttaaaggggttaaattagaatacatcaaaaataaactctacgttagaggtttgaacttaggggaggggcaaaaagtaacactcacatatgatgtgaaactagatgacagttttattagtaacaaattctatgacactaatggtagaacaacattgaatcctaaatcagaggaacctgatacacttagagattttccaatccctaaaattcgtgatgtgagagaatatcctacaataacgattaaaaacgagaagaagttaggtgaaattgaatttacaaaagttgataaagataataataagttgcttctcaaaggagctacatttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccgaaggattatcaaaaaattactaataaaccaattttaacttttgaagttgttaaaggatcgatacaaaatataatagctgttaataaacagatttctgaatatcatgaggaaggtgacaagcatttaattaccaacacgcatattccaccaaaaggaattattccgatgacaggtgggaaaggaattctatctttcattttaataggtggagctatgatgtctattgcaggtggaatttatatttggaaaaaacataagaaatctagtgatgcatcaatcgagaaagattaa

SEQ ID NO: 223 - protein, 674 aa, Streptococcus agalactiae; identical to SEQ ID NO: 97

SEQ ID NO: 224 - protein, 674 aa, Streptococcus agalactiae; identical to SEQ ID NO: 98

SEQ ID NO: 225 - protein, 675 aa, Streptococcus agalactiae; identical to SEQ ID NO: 120

SEQ ID NO: 226 - protein, 693 aa, Streptococcus agalactiae; identical to SEQ ID NO: 93

SEQ ID NO: 227 - protein, 705 aa, Streptococcus agalactiae; identical to SEQ ID NO: 110

SEQ ID NO: 228 - protein, 705 aa, Streptococcus agalactiae; identical to SEQ ID NO: 110

SEQ ID NO: 229 - protein, 308 aa, Streptococcus agalactiae; identical to SEQ ID NO: 60

SEQ ID NO: 230 - protein, 442 aa, Streptococcus agalactiae
MFNKIGFRTWKSGKLWLYMGVLGSTIILGSSPVSAMDSVGNQSQGNVLERRQRDAENRSQGNVLERRQRDVENKSQGNVLERRQRDAENKSQGNVLERRQRDAENRSQGNVLERRQRDAENRSQGNVLERRQRDAENRSQGNVLERRQRDAENRSQGNVLERRQRDAENRSQGNVLERRQRDVENKSQGNVLERRQRDAENKSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENKSQVGQLIGKNPLLSKSIISRENNHSSQGDSNKQSFSKKVSQVTNVANRPMLTNNSRTISVINKLPKTGDDQNVIFKLVGFGLILLTSRCGLRRNEN

SEQ ID NO: 231 - protein, 403 aa, Streptococcus agalactiae; identical to SEQ ID NO: 81

SEQ ID NO: 232 - protein, 674 aa, Streptococcus agalactiae; identical to SEQ ID NO: 97

SEQ ID NO: 233 - protein, 901 aa, Streptococcus agalactiae; identical to SEQ ID NO: 197

SEQ ID NO: 234 - protein, 643 aa, Streptococcus agalactiae
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 235 - protein, 308 aa, Streptococcus agalactiae IC97(III); identical to SEQ ID NO: 56

SEQ ID NO: 236 - protein, 308 aa, Streptococcus agalactiae IC98(II); identical to SEQ ID NO: 56

SEQ ID NO: 237 - protein, 308 aa, Streptococcus agalactiae IC108(III); identical to SEQ ID NO: 55

SEQ ID NO: 238 - protein, 308 aa, Streptococcus agalactiae IC216(Ib); identical to SEQ ID NO: 56

SEQ ID NO: 239 - protein, 308 aa, Streptococcus agalactiae IC244(III); identical to SEQ ID NO: 56

SEQ ID NO: 240 - protein, 308 aa, Streptococcus agalactiae IC245(Ib); identical to SEQ ID NO: 56

SEQ ID NO: 241 - protein, 308 aa, Streptococcus agalactiae IC246(III); identical to SEQ ID NO: 55

SEQ ID NO: 242 - protein, 308 aa, Streptococcus agalactiae IC247(III); identical to SEQ ID NO: 56

SEQ ID NO: 243 - protein, 308 aa, Streptococcus agalactiae IC250(Ib); identical to SEQ ID NO: 56

SEQ ID NO: 244 - protein, 308 aa, Streptococcus agalactiae IC251(V); identical to SEQ ID NO: 56

SEQ ID NO: 245 - protein, 308 aa, Streptococcus agalactiae IC252(III)
MLKKSHFLQIFTLCLALLTISGCQLTDTKKPGRTTIKVAAQSSTESSIMANIVTELIHHELGYNTTLISNLGSSTVTHQALLRGDADIAATRYTGTDITGTLGLKAVKDTKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 246 - protein, 308 aa, Streptococcus agalactiae IC253(III); identical to SEQ ID NO: 60

SEQ ID NO: 247 - protein, 308 aa, Streptococcus agalactiae IC254(II); identical to SEQ ID NO: 56

SEQ ID NO: 248 - protein, 308 aa, Streptococcus agalactiae IC255(V); identical to SEQ ID NO: 56

SEQ ID NO: 249 - protein, 308 aa, Streptococcus agalactiae IC287(V); identical to SEQ ID NO: 56

SEQ ID NO: 250 - protein, 308 aa, Streptococcus agalactiae IC288(Ia); identical to SEQ ID NO: 56

SEQ ID NO: 251 - protein, 308 aa, Streptococcus agalactiae IC289(Ib); identical to SEQ ID NO: 56

SEQ ID NO: 252 - protein, 308 aa, Streptococcus agalactiae IC290(III); identical to SEQ ID NO: 56

SEQ ID NO: 253 - protein, 308 aa, Streptococcus agalactiae IC291(V); identical to SEQ ID NO: 56

SEQ ID NO: 254 - protein, 308 aa, Streptococcus agalactiae IC304(V); identical to SEQ ID NO: 56

SEQ ID NO: 255 - protein, 308 aa, Streptococcus agalactiae IC305(II); identical to SEQ ID NO: 56

SEQ ID NO: 256 - protein, 308 aa, Streptococcus agalactiae IC306(Ib); identical to SEQ ID NO: 56

SEQ ID NO: 257 - protein, 308 aa, Streptococcus agalactiae IC361(Ib); identical to SEQ ID NO: 56

SEQ ID NO: 258 - protein, 308 aa, Streptococcus agalactiae IC363(III); identical to SEQ ID NO: 56

SEQ ID NO: 259 - protein, 308 aa, Streptococcus agalactiae IC364(III); identical to SEQ ID NO: 55

SEQ ID NO: 260 - protein, 308 aa, Streptococcus agalactiae IC365(Ia); identical to SEQ ID NO: 55

SEQ ID NO: 261 - protein, 308 aa, Streptococcus agalactiae IC366(n.t.); identical to SEQ ID NO: 60

SEQ ID NO: 262 - protein, 308 aa, Streptococcus agalactiae IC367(II); identical to SEQ ID NO: 56

SEQ ID NO: 263 - protein, 308 aa, Streptococcus agalactiae IC368(Ia); identical to SEQ ID NO: 56

SEQ ID NO: 264 - protein, 308 aa, Streptococcus agalactiae IC377(V); identical to SEQ ID NO: 56

SEQ ID NO: 265 - protein, 308 aa, Streptococcus agalactiae IC379(Ib)
MLKKSHFLQIFTLCLALLTISGCQLTDTKKSGHTTIKVAAQSSTESSIMANIITELIHHELGYNTTLISNLGSSTVTHQALLRGDADIAATRYTGTDITGTLGLKAVKDPKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLNGKINLKTMQNLNYMVDDKLLEPSVVAKQFLEKNHYFRGDK

SEQ ID NO: 266 - protein, 308 aa, Streptococcus agalactiae IC432(Ib); identical to SEQ ID NO: 56

SEQ ID NO: 267 - protein, 308 aa, Streptococcus agalactiae IC434(III); identical to SEQ ID NO: 55

SEQ ID NO: 268 - protein, 308 aa, Streptococcus agalactiae IC455(III); identical to SEQ ID NO: 56

SEQ ID NO: 269 - protein, 308 aa, Streptococcus agalactiae IC457(II); identical to SEQ ID NO: 56

SEQ ID NO: 270 - protein, 308 aa, Streptococcus agalactiae IC459(Ib); identical to SEQ ID NO: 56

SEQ ID NO: 271 - protein, 308 aa, Streptococcus agalactiae IC460(II); identical to SEQ ID NO: 56

SEQ ID NO: 272 - protein, 308 aa, Streptococcus agalactiae IC461(Ib); identical to SEQ ID NO: 56

SEQ ID NO: 273 - protein, 308 aa, Streptococcus agalactiae IC462(II); identical to SEQ ID NO: 56

SEQ ID NO: 274 - protein, 308 aa, Streptococcus agalactiae IC463(Ib); identical to SEQ ID NO: 56

SEQ ID NO: 275 - protein, 308 aa, Streptococcus agalactiae IC469(V); identical to SEQ ID NO: 56

SEQ ID NO: 276 - protein, 308 aa, Streptococcus agalactiae IC470(V); identical to SEQ ID NO: 56

SEQ ID NO: 277 - protein, 308 aa, Streptococcus agalactiae 126H4A(Ia); identical to SEQ ID NO: 60

SEQ ID NO: 278 - protein, 308 aa, Streptococcus agalactiae 5095S2(Ib); identical to SEQ ID NO: 265

SEQ ID NO: 279 - protein, 308 aa, Streptococcus agalactiae 6313(III); identical to SEQ ID NO: 60

SEQ ID NO: 280 - protein, 308 aa, Streptococcus agalactiae 12351(IV); identical to SEQ ID NO: 56

SEQ ID NO: 281 - protein, 308 aa, Streptococcus agalactiae 12403/2(III); identical to SEQ ID NO: 56

SEQ ID NO: 282 - protein, 308 aa, Streptococcus agalactiae A909(Ia/c); identical to SEQ ID NO: 56

SEQ ID NO: 283 - protein, 308 aa, Streptococcus agalactiae C388/90(Ia/c); identical to SEQ ID NO: 55

SEQ ID NO: 284 - protein, 308 aa, Streptococcus agalactiae BAA22(III); identical to SEQ ID NO: 55

SEQ ID NO: 285 - protein, 308 aa, Streptococcus agalactiae 2603V/R(V); identical to SEQ ID NO: 56

SEQ ID NO: 286 - protein, 308 aa, Streptococcus agalactiae 49447(V)
MLKKSHFLQIFTLCLALLTISGCQLTDTKKPGHTTIKVAAQSSTESSIMANIVTELIHHELGYNTTLISNLGSSTVTHQALLRGDADIAATRYTGTDITGTLGLKAVKDPKEASKIVKTEFQKRYNQTWYPTYGFSDTYAFMVTKEFAKQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRGDK

SEQ ID NO: 287 - protein, 234 aa, Streptococcus agalactiae IC98(II)
LFNKIGFRTWKSGKLWLYMGVLGSTIILGSSPVSAMDSVGNQSQGNVLERRQRDADNKSQGNVLERRQRDVENRSQGNVLERRQRDADNKSQGNVLERRQRDAENKSQGNVLERRQRDVENKSQGNVLERRQRDVENKSQVGQLIGKNPLLSKSTISRENNHSSQGDSNKQSFSKKVSQVTNVANRPMLTNNSRTISVINKLPKTGDDQNVIFKLVGFGLILLTSRCGLRRNEN

SEQ ID NO: 288 - protein, 234 aa, Streptococcus agalactiae IC108(III)
LFNKIGFRTWKSGKLWLYMGVLGSTIILGSSPVSAMDSVGNQSQGNVLERRQRDAENKSQGNVLERRQRDAENKSQGNVLERRQRDVENKSQGNVLERRQRDAENKSQGNVLERRQRDAENKSQGNVLERRQRDADNKSQVGQLIGKNPLFSKPTVSRENNHSSQGDSNKQSFSKKVSQVTNVANRPMLTNNSRTISVINKLPKTGGDQNVIFKLVGFGLILLTSRCGLRRNEN

SEQ ID NO: 289 - protein, 346 aa, Streptococcus agalactiae IC216(Ib)
LFNKIGFRTWKSGKLWLYMGVLGSTIILGSSPVSAMDSVGNQSQGNVLERRQRDADNKSQGNVLERRQRDVENRSQGNVLERRQRDADNKSQGNVLERRQRDAENKSQGNVLERRQRDVENKSQGNVLERRQRDAENKSQGNVLERRQRDADNKSQGNVLERRQRDVENKSQGNVLERRQRDVENKSQGNVLERRQRDAENKSQGNVLERRQRDADNKSQGNVLERRQRDVENKSQGNVLERRQRDVENKSQVGQLIGKNPLLSKSTISRENNHSSQGDSNKQSFSKKVSQVTNVANRPMLTNNSRTISVINKLPKTGDDQNVIFKLVGFGLILLTSRCGLRRNEN

SEQ ID NO: 290 - protein, 346 aa, Streptococcus agalactiae IC245(Ib); identical to SEQ ID NO: 289

SEQ ID NO: 291 - protein, 170 aa, Streptococcus agalactiae IC246(III)
LFNKIGFRTWKSGKLWLYMGVLGSTIILGSSPVSAMDSVGNQSQGNVLERRQRDAENKSQGNVLERRQRDADNKSQVGQLIGKNPLFSKPTVSRENNHSSQGDSNKQSFSKKVSQVTNVANRPMLTNNSRTISVINKLPKTGGDQNVIFKLVGFGLILLTSRCGLRRNEN

SEQ ID NO: 292 - protein, 346 aa, Streptococcus agalactiae IC250(Ib); identical to SEQ ID NO: 289

SEQ ID NO: 293 - protein, 298 aa, Streptococcus agalactiae IC252(III)
LFNKIGFRTWKSGKLWLYMGVLGSTIILGSSPVSAMDSVGNQSQGNVLERRQRDAENRSQGNVLERRQRDAENRSQGNVLERRQRDVENKSQGNVLERRQRDAENKSQGNVLERRQRDAENRSQGNVLERRQRDAENRSQGNVLERRQRDAENRSQGNVLERRQRDAENRSQGNVLERRQRDVENKSQGNVLERRQRDAENKSQVGQLIGKNPLLSKSIISRENNHSSQGDSNKQSFSKKVSQVTNVANRPMLTNNSRTISVINKLPKTGDDQNVIFKLVGFGLILLTSRCGLRRNEN

SEQ ID NO: 294 - protein, 298 aa, Streptococcus agalactiae IC253(III)
LFNKIGFRTWKSGKLWLYMGVLGSTIILGSSPVSAMDSVGNQSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENRSQGNVLERRQRDAENKSQVGQLIGKNPLLSKSIISRENNHSSQGDSNKQSFSKKVSQVTNVANRPMLTNNSRTISVINKLPKTGDDQNVIFKLVGFGLILLTSRCGLRRNEN

SEQ ID NO: 295 - protein, 234 aa, Streptococcus agalactiae IC255(V)
LFNKIGFRTWKSGKLWLYMGVLGSTIILGSSPVSAMDSVGNQSQGNVLERRQRDAENRSQGNVLERRQRDAENKSQGNVLERRQRDADNKSQGNVLERRQRDADNKSQGNVLERRQRDVENKSQGNVLERRQHDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 296 - protein, 234 aa, Streptococcus agalactiae IC289(Ib)
LFNKIGFRTWKSGKLWLYMGVLGSTIILGSSPVSAMDSVGNQSQGNVLERRQRDADNKSQGNVLERRQRDVENKSQGNVLERRQRDAENKSQGNVLERRQRDADNKSQGNVLERRQRDVENKSQGNVLERRQRDVENKSQVGQLIGKNPLLSKSTISRENNHSSQGDSNKQSFSKKVSQVTNVANRPMLTNNSRTISVINKLPKTGDDQNVIFKLVGFGLILLTSRCGLRRNEN

SEQ ID NO: 297 - protein, 154 aa, Streptococcus agalactiae IC290(III)
LFNKIGFRTWKSGKLWLYMGVLGSTIILGSSPVSAMDSVGNQSQGNVLERRQRDADNKSQVGQLIGKNPLFSKSTVSRENNHSSQGDSNKQSFSKKISQVTNVANRPMLTNNSRTISVINKLPKTGDDQNVIFKLVGFGLILLTSLCGLRRNEN

SEQ ID NO: 298 - protein, 282 aa, Streptococcus agalactiae IC291(V)
LFNKIGFRTWKSGKLWLYMGVLGSTIILGSSPVSAMDSVGNQSQGNVLERRQRDAENRSQGNVLERRQRDAENRSQGNVLERRQRDAENRSQGNVLERRQRDVENKSQGNVLERRQRDVENKSQGNVLERRQRDAENKSQGNVLERRQRDAENKSQGNVLERRQRDVENKSQGNVLERRQHDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 299 - protein, 234 aa, Streptococcus agalactiae IC304(V)
LFNKIGFRTWKSGKLWLYMGVLGSTIILGSSPVSAMDSVGNQSQGNVLERRQRDAENRSQGNVLERRQRDVENKSQGNVLERRQNNVLIKSQDNVLERRQRDADNKSQGNVLERRQRDVENKSQGNVLERRQHDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 300 - protein, 234 aa, Streptococcus agalactiae IC305(II); identical to SEQ ID NO: 287

SEQ ID NO: 301 - protein, 346 aa, Streptococcus agalactiae IC306(Ib); identical to SEQ ID NO: 289

SEQ ID NO: 302 - protein, 346 aa, Streptococcus agalactiae IC361(Ib); identical to SEQ ID NO: 289

SEQ ID NO: 303 - protein, 218 aa, Streptococcus agalactiae IC364(III); identical to SEQ ID NO: 70

SEQ ID NO: 304 - protein, 314 aa, Streptococcus agalactiae IC365(Ia)
LFNKIGFRTWKSGKLWLYMGVLGSTIILGSSPVSAMDSVGNQSQGNVLERRQRDADNKSQGNVLERRQRDVENKSQGNVLERRQRDVENKSQGNVLERRQRDADNRSQGNVLERRQRDADNRSQGNVLERRQRDVENKSQGNVLERRQRDVENKSQGNVLERRQRDVENKSQGNVLERRQRDAENKSQGNVLERRQRDVENKSQGNVLERRQRDVENKSQVGQLIEKNPLLSKSTVSRENNHSSQGDSNKQSFSKKVSQVTNVANRPMLTNNSRTISVINKLPKTGDDQNVIFKLVGFGLILLTSLCGLRRNEN

SEQ ID NO: 305 - protein, 346 aa, Streptococcus agalactiae IC368(Ia); identical to SEQ ID NO: 289

SEQ ID NO: 306 - protein, 330 aa, Streptococcus agalactiae IC377(V)
LFNKIGFRTWKSGKLWLYMGVLGSTIILGSSPVSAMDSVGNQSQGNVLERRQRDAENRSQGNVLERRQRDVENKSQGNVLERRQRDADNKSQGNVLERRQRDVENKSQGNVLERRQNNVLIKSQDNVLERRQRDADNKSQGNVLERRQRDADNKSQGNVLERRQRDVENKSQGNVLERRQNNVLIKSQDNVLERRQRDADNKSQGNVLERRQRDVENKSQGNVLERRQHDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 307 - protein, 346 aa, Streptococcus agalactiae IC379(Ib); identical to SEQ ID NO: 289

SEQ ID NO: 308 - protein, 218 aa, Streptococcus agalactiae IC434(III); identical to SEQ ID NO: 70

SEQ ID NO: 309 - protein, 186 aa, Streptococcus agalactiae IC457(II)
LFNKIGFRTWKSGKLWLYMGVLGSTIILGSSPVSAMDSVGNQSQGNVLERRQRDADNKSQGNVLERRQRDVENRSQGNVLERRQRDVENKSQVGQLIGKNPLLSKSTISRENNHSSQGDSNKQSFSKKVSQVTNVANRPMLTNNSRTISVINKLPKTGDDQNVIFKLVGFGLILLTSRCGLRRNEN

SEQ ID NO: 310 - protein, 346 aa, Streptococcus agalactiae IC461(Ib); identical to SEQ ID NO: 289

SEQ ID NO: 311 - protein, 442 aa, Streptococcus agalactiae IC469(V)
LFNKIGFRTWKSGKLWLYMGVLGSTIILGSSPVSAMDSVGNQSQGNVLERRQRDAENKSQGNVLERRQRDAENRSQGNVLERRQRDVENKSQGNVLERRQRDVDNKSQGNVLERRQRDVENKSQGNVLERRQRDVLIKSQGNDLERRQRDADNKSQGNVLERRQRDVENRSQGNVLERRQRDAENKSQGNVLERRQRDVENKSQGNVLERRQRDADNKSQGNVLERRQRDAENKSQGNVLERRQRDVENKSQGNVLERRQRDADNKSQGNVLERRQRDVDNKSQGNVLERRQNNVLIKSQDNVLERRQRDADNKSQGNVLERRQRDVENKSQGNVLERRQHDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 312 - protein, 346 aa, Streptococcus agalactiae A909(Ia/c); identical to SEQ ID NO: 289

SEQ ID NO: 313 - protein, 298 aa, Streptococcus agalactiae C388/90(Ia/c)
LFNKIGFRTWKSGKLWLYMGVLGSTIILGSSPVSAMDSVGNQSQGNVLERRQRDADNKSQGNVLERRQRDVENKSQGNVLERRQRDVENKSQGNVLERRQRDADNRSQGNVLERRQRDVENKSQGNVLERRQRDVENKSQGNVLERRQRDVENKSQGNVLERRQRDAENKSQGNVLERRQRDVENKSQGNVLERRQRDVENKSQVGQLIEKNPLLSKSTVSRENNHSSQGDSNKQSFSKKVSQVTNVANRPMLTNNSRTIPVINKLPKTGDDQNVIFKLVGFGLILLTSLCGLRRNEN

SEQ ID NO: 314 - protein, 218 aa, Streptococcus agalactiae BAA22(III); identical to SEQ ID NO: 70

SEQ ID NO: 315 - protein, 570 aa, Streptococcus agalactiae 2603V/R(V)
LFNKIGFRTWKSGKLWLYMGVLGSTIILGSSPVSAMDSVGNQSQGNVLERRQRDAENRSQGNVLERRQRDAENRSQGNVLERRQRDAENRSQGNVLERRQRDVENKSQGNVLERRQRDVENKSQGNVLERRQRDAENKSQGNVLERRQRDAENKSQGNVLERRQRDVENKSQGNVLERRQRDAENKSQGNVLERRQRDAENKSQGNVLERRQRDAENRSQGNVLERRQRDVENKSQGNVLERRQRDVENKSQGNVLERRQRDADNKSQGNVLERRQRDVENKSQGNVLERRQRDVENKSQGNVLERRQRDAENKSQGNVLERRQRDAENRSQGNVLERRQRDAENRSQGNVLERRQRDAENRSQGNVLERRQRDAENRSQGNVLERRQRDVENKSQGNVLERRQRDVENKSQGNVLERRQRDADNKSQGNVLERRQRDVENKSQGNVLERRQRDVENKSQGNVLERRQRDVENKSQVGQLIGKNPLFSKSTVSRENNHSSQGDSNKQSFSKKVSQVTNVANRPMLTNNSRTISVINKLPKTGDDQNVIFKLVGFGLILLTSLCGLRRNEN

SEQ ID NO: 316 - protein, 602 aa, Streptococcus agalactiae 49447(V)
LFNKIGFRTWKSGKLWLYMGVLGSTIILGSSPVSAMDSVGNQSQGNVLERRQRDADNKSQGNVLERRQRDADNKSQGNVLERRQRDVENKSQGNVLERRQRDVENKSQGNVLERRQRDADNKSQGNVLERRQRDVENKSQGNVLERRQRDAENKSQGNVLERRQRDVENKSQGNVLERRQRDADNKSQGNVLERRQRDADNKSQGNVLERRQRDADNKSQGNVLERRQRDADNKSQGNVLERRQRDADNKSQGNVLERRQRDAENKSQGNVLERRQRDADNKSQGNVLERRQRDAENKSQGNVLERRQRDADNKSQGNVLERRQRDAENKSQGNVLERRQRDVENKSQGNVLERRQRDADNKSQGNVLERRQRDADNKSQGNVLERRQRDADNKSQGNVLERRQRDADNKSQGNVLERRQRDADNKSQGNVLERRQRDADNKSQGNVLERRQRDADNKSQGNVLERRQRDADNKSQGNVLERRQRDADNKSQGNVLERRQRDAENKSQVGQLIGKNPLFSKSTVSRENNHSSQGDSNKQSFSKKISQVTNVANGPMLTNNSRTISVINKLPKTGDDQNVIFKLVGFGLILLTSLCGLRRNEN

SEQ ID NO: 317 - protein, 403 aa, Streptococcus agalactiae IC98(II)
FSVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIIFERANGLRELFFGSWRKVYSEYKEGSFSAGRLFKKTDELDKFSKPLLKNGRKWSITGIKTK

SEQ ID NO: 318 - protein, 403 aa, Streptococcus agalactiae IC216(Ib); identical to SEQ ID NO: 317

SEQ ID NO: 319 - protein, 403 aa, Streptococcus agalactiae IC244(III)
FSVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFASDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIKTK

SEQ ID NO: 320 - protein, 403 aa, Streptococcus agalactiae IC245(Ib); identical to SEQ ID NO: 317

SEQ ID NO: 321 - protein, 403 aa, Streptococcus agalactiae IC247(III); identical to SEQ ID NO: 319

SEQ ID NO: 322 - protein, 403 aa, Streptococcus agalactiae IC250(Ib); identical to SEQ ID NO: 317

SEQ ID NO: 323 - protein, 403 aa, Streptococcus agalactiae IC251(V); identical to SEQ ID NO: 81

SEQ ID NO: 324 - protein, 403 aa, Streptococcus agalactiae IC252(III); identical to SEQ ID NO: 81

SEQ ID NO: 325 - protein, 403 aa, Streptococcus agalactiae IC253(III); identical to SEQ ID NO: 81

SEQ ID NO: 326 - protein, 403 aa, Streptococcus agalactiae IC255(V)
FSVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFGDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIKTK

SEQ ID NO: 327 - protein, 403 aa, Streptococcus agalactiae IC287(V); identical to SEQ ID NO: 81

SEQ ID NO: 328 - protein, 403 aa, Streptococcus agalactiae IC288(Ia); identical to SEQ ID NO: 317

SEQ ID NO: 329 - protein, 403 aa, Streptococcus agalactiae IC289(Ib)
FSVTYSQSERTVVFSFGEITFSRSRWTNGFETRIPVDEWLGLEKYKRYSIEFLYHVAKLATMMPYCQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNSDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIIFERANGLRELFFGSWRKVYSEYKEGSFSAGRLFKKTDELDKFSKPLLKNGRKWSITGIKTK

SEQ ID NO: 330 - protein, 403 aa, Streptococcus agalactiae IC290(III); identical to SEQ ID NO: 319

SEQ ID NO: 331 - protein, 403 aa, Streptococcus agalactiae IC291(V); identical to SEQ ID NO: 81

SEQ ID NO: 332 - protein, 403 aa, Streptococcus agalactiae IC304(V); identical to SEQ ID NO: 81

SEQ ID NO: 333 - protein, 403 aa, Streptococcus agalactiae IC305(II); identical to SEQ ID NO: 317

SEQ ID NO: 334 - protein, 403 aa, Streptococcus agalactiae IC306(Ib); identical to SEQ ID NO: 317

SEQ ID NO: 335 - protein, 403 aa, Streptococcus agalactiae IC361(Ib); identical to SEQ ID NO: 317

SEQ ID NO: 336 - protein, 403 aa, Streptococcus agalactiae IC363(III); identical to SEQ ID NO: 319

SEQ ID NO: 337 - protein, 403 aa, Streptococcus agalactiae IC364(III); identical to SEQ ID NO: 81

SEQ ID NO: 338 - protein, 403 aa, Streptococcus agalactiae IC365(Ia); identical to SEQ ID NO: 317

SEQ ID NO: 339 - protein, 403 aa, Streptococcus agalactiae IC366(n.t.); identical to SEQ ID NO: 81

SEQ ID NO: 340 - protein, 403 aa, Streptococcus agalactiae IC368(Ia); identical to SEQ ID NO: 317

SEQ ID NO: 341 - protein, 403 aa, Streptococcus agalactiae IC377(V); identical to SEQ ID NO: 81

SEQ ID NO: 342 - protein, 403 aa, Streptococcus agalactiae IC379(Ib); identical to SEQ ID NO: 317

SEQ ID NO: 343 - protein, 403 aa, Streptococcus agalactiae IC432(Ib); identical to SEQ ID NO: 317

SEQ ID NO: 344 - protein, 403 aa, Streptococcus agalactiae IC455(III); identical to SEQ ID NO: 319

SEQ ID NO: 345 - protein, 403 aa, Streptococcus agalactiae IC457(II); identical to SEQ ID NO: 317

SEQ ID NO: 346 - protein, 403 aa, Streptococcus agalactiae IC459(Ib); identical to SEQ ID NO: 317

SEQ ID NO: 347 - protein, 403 aa, Streptococcus agalactiae IC460(II); identical to SEQ ID NO: 317

SEQ ID NO: 348 - protein, 403 aa, Streptococcus agalactiae IC461(Ib); identical to SEQ ID NO: 317

SEQ ID NO: 349 - protein, 403 aa, Streptococcus agalactiae IC463(Ib); identical to SEQ ID NO: 81

SEQ ID NO: 350 - protein, 403 aa, Streptococcus agalactiae IC469(V); identical to SEQ ID NO: 81

SEQ ID NO: 351 - protein, 403 aa, Streptococcus agalactiae 126H4A(Ia); identical to SEQ ID NO: 81

SEQ ID NO: 352 - protein, 403 aa, Streptococcus agalactiae 6313(III); identical to SEQ ID NO: 81

SEQ ID NO: 353 - protein, 403 aa, Streptococcus agalactiae 12351(IV); identical to SEQ ID NO: 81

SEQ ID NO: 354 - protein, 403 aa, Streptococcus agalactiae 12403/2(III); identical to SEQ ID NO: 81

SEQ ID NO: 355 - protein, 403 aa, Streptococcus agalactiae A909(Ia/c); identical to SEQ ID NO: 81

SEQ ID NO: 356 - protein, 403 aa, Streptococcus agalactiae C388/90(Ia/c); identical to SEQ ID NO: 80

SEQ ID NO: 357 - protein, 444 aa, Streptococcus agalactiae BAA22(III); identical to SEQ ID NO: 82

SEQ ID NO: 358 - protein, 403 aa, Streptococcus agalactiae 2603V/R(V); identical to SEQ ID NO: 81

SEQ ID NO: 359 - protein, 403 aa, Streptococcus agalactiae 49447(V)
FSVTYSQSERTVVFSFGEITFSRSRWTNGFETRIPVDEWLGLEKYKRYSIEFLYHVAKLATMMPYRQVCKVIDSTLQTIITKDCVLKAVKFVEKLLKEKERYRFYLEEPPERKKVKKLYVEGDGVMIKSTDSREERRYLDLTHFVIHTGSKKVSTKRYELQDKHEILQLNYDKAKYNLLDYIYNNYEVDDDTILITNFDMGKGYTSRVFKELGKALKVKKHEHFWDIYHVKEKLSSYLRKYPIELTDFALDAVKKYNSDKLELVFDTVESLICDELEDQEFQKFKKKVLNNFKYIKPAHLRNLSNRGIGIMESQHRKITYRMKRRGMYWSKWGISTMANMIILERANGLRELFFGSWRKVYSEYKEGSFSAGRLFKKTDELDKFSKPLLKNGRKWSITGIKTK

SEQ ID NO: 360 - protein, 675 aa, Streptococcus agalactiae IC252/2(III); identical to SEQ ID NO: 100

SEQ ID NO: 361 - protein, 693 aa, Streptococcus agalactiae 12403/2(III); identical to SEQ ID NO: 93

SEQ ID NO: 362 - protein, 674 aa, Streptococcus agalactiae 2603V/R(V); identical to SEQ ID NO: 98

SEQ ID NO: 363 - protein, 901 aa, Streptococcus agalactiae IC365(Ia)
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPDDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPKTGGKGILSFILIGGAMMSIAGGIYIWKRYKKSSDMSIKKD

SEQ ID NO: 364 - protein, 896 aa, Streptococcus agalactiae IC366(n.t.); identical to SEQ ID NO: 203

SEQ ID NO: 365 - protein, 901 aa, Streptococcus agalactiae IC367(II); identical to SEQ ID NO: 186

SEQ ID NO: 366 - protein, 901 aa, Streptococcus agalactiae IC377(V); identical to SEQ ID NO: 195

SEQ ID NO: 367 - protein, 901 aa, Streptococcus agalactiae IC379(Ib); identical to SEQ ID NO: 186

SEQ ID NO: 368 - protein, 901 aa, Streptococcus agalactiae IC432(Ib); identical to SEQ ID NO: 186

SEQ ID NO: 369 - protein, 901 aa, Streptococcus agalactiae IC455(III)
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQILQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 370 - protein, 901 aa, Streptococcus agalactiae IC457(II); identical to SEQ ID NO: 186

SEQ ID NO: 371 - protein, 901 aa, Streptococcus agalactiae IC459(Ib); identical to SEQ ID NO: 186

SEQ ID NO: 372 - protein, 901 aa, Streptococcus agalactiae IC460(II)
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDMREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 373 - protein, 901 aa, Streptococcus agalactiae IC461(Ib); identical to SEQ ID NO: 186

SEQ ID NO: 374 - protein, 901 aa, Streptococcus agalactiae IC462(II)
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYLSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 375 - protein, 901 aa, Streptococcus agalactiae IC469(V); identical to SEQ ID NO: 186

SEQ ID NO: 376 - protein, 901 aa, Streptococcus agalactiae IC470(V); identical to SEQ ID NO: 186

SEQ ID NO: 377 - protein, 518 aa, Streptococcus agalactiae 0176H4A(II)
MRKYQKFSKILTLSLFCLSQIPLNTNVLGESTVPENGAKGKLVVKKTDDQNKPLSKATFVLKPTSHSESKVEKVTTEVTGEATFDNLTPGDYTLSEETAPEGYKKTTQTWQVKVESNGKTTIQNSDDKKSIIEQRQEELDKQYPLTGAYEDTKESYNLEHVKNSIPNGKLEAKAVNPYSSEGEHIREIQEGTLSKRISEVNDLDHNKYKIELTVSGKSIIKTINKDEPLDVVFVLDNSNSMKNNGKNNKAKKAGEAVETIIKDVLGANVENRAALVTYGSDIFDGRTVKVIKGFKEDPYYGLETSFTVQTNDYSYKKFTNIAADIIKKIPKEAPEAKWGGTSLGLTPEKKREYDLSKVGETFTMKAFMEADTLLSSIQRKSRKIIVHLTDGVPTRSYAINSFVTGSTYANQFERIKEKGYLDKNNYFITDDPEKIKGNGESYFLFPLDSYQTQIISGNLQKLHYLDLNLNYPKGTIYRNGPVREHGTPTKLYINSLKQKNYDIFNFGIDISGFRQVYN

SEQ ID NO: 378 - protein, 901 aa, Streptococcus agalactiae 2603V/R(V)
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 379 - protein, 748 aa, Streptococcus agalactiae IC97(III)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPDVKPEAKPDVKPEARPEAKPEAKPEAKPEIKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 380 - protein, 752 aa, Streptococcus agalactiae IC98(II)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKARHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPDVKPDVKPDVKPEVKPEAKPEAKPEAKPEIKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 381 - protein, 752 aa, Streptococcus agalactiae IC216(Ib); identical to SEQ ID NO: 380

SEQ ID NO: 382 - protein, 630 aa, Streptococcus agalactiae IC244(III)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAKPDVKPEAKPDVKPEAKPDVKPKAKPDVKPEAKPDVKPDVKPDVKPEAKPEDKPDVKPDVKPEAKPDVKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 383 - protein, 752 aa, Streptococcus agalactiae IC245(Ib); identical to SEQ ID NO: 380

SEQ ID NO: 384 - protein, 630 aa, Streptococcus agalactiae IC247(III); identical to SEQ ID NO: 382

SEQ ID NO: 385 - protein, 752 aa, Streptococcus agalactiae IC250(Ib); identical to SEQ ID NO: 380

SEQ ID NO: 386 - protein, 816 aa, Streptococcus agalactiae IC251(V)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPDVKPDVKPEAKPEAKPEAKPEAKPEAKPEAKPEAKPEVKPDVKPEAKPDVKPEAKPDVKPEVKPDVKPEAKPDVKPEAKPDVKPEVKPEAKPEVKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 387 - protein, 643 aa, Streptococcus agalactiae IC252(III); identical to SEQ ID NO: 234

SEQ ID NO: 388 - protein, 643 aa, Streptococcus agalactiae IC253(III); identical to SEQ ID NO: 234

SEQ ID NO: 389 - protein, 735 aa, Streptococcus agalactiae IC254(II)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPDVKPEAKPDVKPEAKPDVKPEAKPDVKPEAKPDVKPEAKPDVKPKAKPDVKPEAKPDVKPDVKPDVKPEAKPEDKPDVKPDVKPEAKPDVKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 390 - protein, 816 aa, Streptococcus agalactiae IC255(V); identical to SEQ ID NO: 386

SEQ ID NO: 391 - protein, 816 aa, Streptococcus agalactiae IC287(V); identical to SEQ ID NO: 386

SEQ ID NO: 392 - protein, 720 aa, Streptococcus agalactiae IC289(Ib)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPEAKPEAKPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 393 - protein, 634 aa, Streptococcus agalactiae IC290(III)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGYMKAELQDLTRGTKEDKKPDVKPEAKPEAKPDVKPEAKPDVKSEAKPDVKPEAKPDVKPEAKPDVKPKAKPDVKPEAKPDVKPDVKPDVKPEAKPEDKPDVKPDVKPEAKPDVKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 394 - protein, 647 aa, Streptococcus agalactiae IC291(V)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPDVKPEVKPDVKPEAKPDVKPEAKPDVKPEVKPEAKPEVKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 395 - protein, 687 aa, Streptococcus agalactiae IC304(V)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPEAKPEAKPEAKPEAKPEVKPDVKPEAKPDVKPEAKPDVKPEVKPDVKPEAKPDVKPEAKPDVKPEVKPEAKPEVKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 396 - protein, 623 aa, Streptococcus agalactiae IC305(II)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKARHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPEAKPEAKPEIKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 397 - protein, 752 aa, Streptococcus agalactiae IC306(Ib)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKARHMAQNDVASIKNISLEVLEEYKEKIQRASTKSQVDELVAEAKKVVNFNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPDVKPDVKPDVKPEVKPEAKPEAKPEAKPEIKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 398 - protein, 748 aa, Streptococcus agalactiae IC361(Ib)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKARHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPDVKPDVKPEVKPEAKPEAKPEAKPEIKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 399 - protein, 630 aa, Streptococcus agalactiae IC363(III)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELKDLTRGTKEDKKPDVKPEAKPEAKPDVKPEAKPDVKPEAKPDVKPEAKPDVKPEAKPDVKPEAKPDVKPKAKPDVKPEAKPDVKPDVKPDVKPEAKPEDKPDVKPDVKPEAKPDVKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 400 - protein, 727 aa, Streptococcus agalactiae IC365(Ia)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKNADEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPDVKPEAKPDVKPEAKPDVKPEAKPDVKPEAKPDVKPEAKPDVKPEAKPDVKPKAKPDVKPEAKPDVKPDVKPDVKPEAKPEAKPDVKPDVKPEAKPDVKPEAKPEAKPDVKPEAKPDVKPEAKPEAKPEAKSEAKPEAKLEAKPEAKPATKKSVNTSGNLAVKKAIENKKYSKKLPSTGEAASPLLAIVSLIVMLSAGLITIVLKHKKN

SEQ ID NO: 401 - protein, 643 aa, Streptococcus agalactiae IC366(n.t.); identical to SEQ ID NO: 234

SEQ ID NO: 402 - protein, 752 aa, Streptococcus agalactiae IC367(II); identical to SEQ ID NO: 380

SEQ ID NO: 403 - protein, 820 aa, Streptococcus agalactiae IC368(Ia); identical to SEQ ID NO: 178

SEQ ID NO: 404 - protein, 816 aa, Streptococcus agalactiae IC377(V); identical to SEQ ID NO: 386

SEQ ID NO: 405 - protein, 752 aa, Streptococcus agalactiae IC379(Ib)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKARHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQKNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLCDALQSLELKDKKVAKPEAKPEVKPEAKPDVKPDVKPDVKPEVKPEAKPEAKPEAKPEIKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 406 - protein, 752 aa, Streptococcus agalactiae IC432(Ib); identical to SEQ ID NO: 380

SEQ ID NO: 407 - protein, 630 aa, Streptococcus agalactiae IC455(III)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPDVKPEAKPDVKPEAKPDVKPEAKPDVKPEAKPDVKPEAKPDVKPKAKPDVKPEAKLDVKPDVKPDVKPEAKPEDKPDVKPDVKPEAKPDVKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 408 - protein, 748 aa, Streptococcus agalactiae IC457(II); identical to SEQ ID NO: 398

SEQ ID NO: 409 - protein, 752 aa, Streptococcus agalactiae IC459(Ib); identical to SEQ ID NO: 380

SEQ ID NO: 410 - protein, 723 aa, Streptococcus agalactiae IC460(II)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEVKPEAKPDVKPDVKPEAKPEAKPEAKPEAKPEAKPEAKPEAKPEVKPDVKPEAKPDVKPEAKPDVKPEVKPDVKPEAKPDVKPEAKPDVKPEVKPEAKPEVKPDVKPEARPEAKPEVKPDVKPEAKPEAKPEVKPDVKPEAKPEAKPATKKSVNTSGNLAVKKAIENKKYSKKLPSTGEAASPLLAIVSLIVMLSAGLITIVLKHKKN

SEQ ID NO: 411 - protein, 752 aa, Streptococcus agalactiae IC461(Ib); identical to SEQ ID NO: 380

SEQ ID NO: 412 - protein, 735 aa, Streptococcus agalactiae IC462(II)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPDVKPEAKPDVKPEAKPDVKPEAKPDVKPEAKPDVKPEAKPDVKPKAKPDVKPEAKPDVKPDVKPDVKPEAKPEDKPDVKPDVKPEAKPDVKPEAKPEAKPEAKPEAKPEAKPEAKPDVKPEAKPDVKPEAKPEAKPEAKSEAKPEAKLEAKPEAKPATKKSVNTSGNLAVKKAIENKKYSKKLPSTGEAASPLLAIVSLIVMLSAGLITIVLKHKKN

SEQ ID NO: 413 - protein, 740 aa, Streptococcus agalactiae IC463(Ib)
MNNNEKKVKYFLRKTAYGLASMSAAFAVCSGIVHADTSSGISDSIPHKKQVNLGAVTLKNLISKYRGNDKAIAILLSRVDDFNRASQDTLPQLINSTEAEINNTLPQGRIIKQSIPVVRLKVERLGSGAIKAESINNIKAESINKIQGKSTNTIKAESINKIKVESINTIKAESINKIQAKPINTIKAESINTIKAESIHKIKPQSIKSTSATHVKVSDQELAKQSRRSQDIIKSLGFLSSDQKDILVKSISSSKDSQLILKFVTQATQLNNAESTKAKHMAQNDVASIKNISLEVLEEYKEKIQRASTKSQVDELVAEAKKVVNSNKETLVNQANGKKQEIAKLENLSNDEMLRYNTAIDNVVKQYNEGKLNITDAMNALNSIKQAAQEVAQRNLQKQYAKKIERISLKGLALSKKAKEIYEKHKSILPTPGYYADSVGTYLNRFRDKRTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEIKPEAKPEAKPEAKPEVKPDVKPEAKPDVKPEAKPDVKPEVKPDVKPEAKPDVKPEVKPDVKPEAKPEAKPATKKSVNTSGNLAVKKAIENKKYSKKLPSTGEAASPLLAIVSLIVMLSAGLITIVLKHKKN

SEQ ID NO: 414 - protein, 816 aa, Streptococcus agalactiae IC469(V); identical to SEQ ID NO: 386

SEQ ID NO: 415 - protein, 816 aa, Streptococcus agalactiae IC470(V); identical to SEQ ID NO: 386

SEQ ID NO: 416 - protein, 643 aa, Streptococcus agalactiae 126H4A(Ia); identical to SEQ ID NO: 234

SEQ ID NO: 417 - protein, 752 aa, Streptococcus agalactiae 5095S2(Ib); identical to SEQ ID NO: 405

SEQ ID NO: 418 - protein, 643 aa, Streptococcus agalactiae 6313(III)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPEAKPEAKPEAKPEAKPEAKPEAKPEAKPEAKPDVKPEAKPDVKPEAKPEAKPEAKSEAKPEAKPATKKSVNTSGNLAAKKAIENKKYSKKLPSTGEAASPLLAIVSLIVMLSAGLITIVLKHKKN

SEQ ID NO: 419 - protein, 752 aa, Streptococcus agalactiae 12351(IV); identical to SEQ ID NO: 380

SEQ ID NO: 420 - protein, 748 aa, Streptococcus agalactiae 12403/2(III); identical to SEQ ID NO: 379

SEQ ID NO: 421 - protein, 522 aa, Streptococcus agalactiae COH1(III)
MNNNEKKVKYFLRKTAYGLASMSAAFIVCSGIVNTPTVSADSPDTLKVEKLGKLKDVKSVHELTPISIPNELKGAKEQALSSIISHPNITNSEVDKLASDYSFRINTSNDVNDVKRLLNEFYNAVARKQLDTNSADYRSKIDNISTTGLAIALEAKEIYEANKSILPHRYKDSVGTYVNSFEERRSPGKFNIWNGQEGFNAAQKLLEDVKKLLLELQNLTKNNKPNIQVPKQAPTEAAKPALSPEALTRLTTWYNQAKDLLKDDQVKDKYVDILSVQKAVDQAYDHVEEGKFITTDQANQLANKLRDALQSLELKDKKVAKPVAKGTYDVKYVDTEGKEVAKSRHFEGEEGAAFVTSAKEVAGYKLVRTEGAVSNVFTAGAQVRTYVYEKVKPEVKPDVKPEAKPEAKPEVKPDVKPEAKPEAKPEVKSDVKPEAKPEAKPEAKPEVKPDVKPEAKPEAKPATKKSVNTSGNLVAKKAIENKKYSKKLPSTGEAASPLLAIVSLIVMLSAGLITIVLKHKKN

SEQ ID NO: 422 - protein, 743 aa, Streptococcus agalactiae C388/90(Ia/c)
MNNNEKKVKYFLRKTAYGLASMSAAFAVCSGIVHADTSSGISASIPHKKQVNLGAVTLKNLISKYRGNDKAIAILLSRVNDFNRASQDTLPQLINSTEAEIRNILYQGQIGKQNKPSVTTHAKVSDQELGKQSRRSQDIIKSLGFLSSDQKDILVKSISSSKDSQLILKFVTQATQLNNAESTKAKQMAQNDVALIKNISPEVLEEYKEKIQRASTKSQVDEFVAEAKKVVNSNKETLVNQANGKKQEIAKLENLSNDEMLRYNTAIDNVVKQYNEGKLNITAAMNALNSIKQAAQEVAQKNLQKQYAKKIERISSKGLALSKKAKEIYEKHKSILPTPGYYADSVGTYLNRFRDKQTFGNRSVWTGQSGLDEAKKMLDEVKKLLKELQDLTRGTKEDKKPDVKPEAKPEAKPNIQVPKQAPTEAAKPALSPEALTRLTTWYNQAKDLLKDDQVKDKYVDILAVQKAVDQAYDHVEEGKFITTDQANQLANKLRDALQSLELKDKKVAKPEAKPEAKPDVKPEAKPDVKPEAKPDVKPEAKPDVKPEAKPDVKPEAKPDVKPKAKPDVKPEAKPDVKPDVKPDVKPDVKPEAKPEAKPDVKPDVKPEAKPDVKPEAKPEAKPEAKPEAKPEAKPEAKPEAKPDVKPEAKPDVKPEAKPEAKPEAKSEAKPEAKLEAKPEAKPATKKSVNTSGNLAAKKAIENKKYSKKLPSTGEAASPLLAIVSLIVMLSAGLITIVLKHKKN

SEQ ID NO: 423 - protein, 594 aa, Streptococcus agalactiae BAA22(III)
MNNNEKKVKYFLRKTAYGLASMSAAFIVCSGIVNTPTVSADSPDTLKVEKLGKLKDVKSVHELTPISIPNELKGAKEQALSSIISHPNITNSEVDKLASDYSFRINTSNDVNDVKRLLNEFYNAVARKQLDTNSADYRSKIDNISTTGLAIALEAKEIYEANKSILPHRYKDSVGTYVNSFEERRSPGKFNIWNGQEGFNAAQKLLEDVKKLLLELQNLTKNNKPNIQVPKQAPTEAAKPALSPEALTRLTTWYNQAKDLLKDDQVKDKYVDILSVQKAVDQAYDHVEEGKFITTDQANQLANKLRDALQSLELKDKKVAKPVAKGTYDVKYVDTEGKEVAKSRHFEGEEGAAFVTSAKEVAGYKLVRTEGAVSNVFTAGAQVRTYVYEKVAKPVAKGTYDVKYVDTEGKEVAKSRHFEGEEGAAFVTSAKEVAGYKLVRTEGAVSNVFTAGAQVRTYVYEKVKPEVKPDVKPEAKPEAKPEVKPDVKPEAKPEAKPEVKSDVKPEAKPEAKPEAKPEVKPDVKPEAKPEAKPATKKSVNTSGNLVAKKAIENKKYSKKLPSTGEAASPLLAIVSLIVMLSAGLITIVLKHKKN

SEQ ID NO: 424 - protein, 816 aa, Streptococcus agalactiae 2603V/R(V); identical to SEQ ID NO: 386

SEQ ID NO: 425 - protein, 533 aa, Streptococcus agalactiae 49447(V)
MNNNEKKVKYFLRKSAYGLVSMSAAFIVCSGIVNTPTVSAESVGIDAKPINRIEAKSVNTINAISIPKQLTEAKNRAYVKINTHPSMSDQSVQSLADIYRSKVYKAVSVDEVDRLVEQFYNEINRKKTDVTPEEASQKIDELSVTGLTMMVEADEIYQKHKDLLHSHYKDSIGTYTNLFTNRGGVTPWVGAEGLKDAQEAFRKAKVLLANLKALQEQIEKTQKKPVAKGTYDVKYVDTEGKEVAKSRHFEGEEGAAFVISAKEVAGYKLVRTEGAVSNVFTAGAQVRTYVYEKVAKPVAKGTYDVKYVDTEGKEVAKSRHFEGEEGAAFVTSAKEVAGYKLVRTEGAVLNVFTAGAQVRTYVYEKVKPDVKPEAKPEAKPEAKPEAKPEAKPEAKPEVKPEVKPDVKPEAKPEAKPEVKPDVKPEAKPEAKPEVKPEVKPEVKPDVKPEAKPEAKPEVKPDVKPEAKPEAKPATKKSVNTSGNLAAKKAIENKKYSKKLPSTGEAASPLLAIVSLIVMLSAGLITIVLKHKKN

The invention claimed is:

1. A composition comprising a first protective protein and a second protective protein,
   i) wherein the first protective protein consists of the amino acid sequence of SEQ ID NO: 4 (gbs1477p) or functionally active protein that consists of at least 95% identity to the sequence of SEQ ID NO: 4, and
   wherein the functionally active protein shows at least 80% of the protection shown for the protective protein of SEQ ID NO: 4 against a challenge with at least one strain of *S. agalactiae* used in a dose of $10^6$-$10^8$ cfu in a lethal sepsis model, wherein the strain is selected from the group consisting of C388/90, A909, ATCC12401, ATCC1243, COH1, BAA22, BAA23, 2603V/R, and ATCC49447;
   ii) wherein the second protective protein consists of the amino acid sequence of SEQ ID NO: 5 (gbs1478p) or functionally active protein that consists of at least 95% identity to the sequence of SEQ ID NO: 5; and
   wherein the functionally active protein shows at least 80% of the protection shown for the protective protein of SEQ ID NO: 5 against challenge with at least one strain of *S. agalactiae* used in a dose of $10^6$-$10^8$ cfu in a lethal sepsis model, wherein the strain is selected from the group consisting of C388/90, A909, ATCC12401, ATCC1243, COH1, BAA22, BAA23, 2603V/R, and ATCC49447.

2. The composition of claim 1, wherein the first protective protein consists of the amino acid sequence of SEQ ID NO: 4 (gbs1477p).

3. The composition of claim 1, wherein the second protective protein consists of the amino acid sequence of SEQ ID NO: 5 (gbs1478p).

4. The composition of claim 1, wherein the first protective protein and the second protective protein are combined into at least one fusion protein.

5. A pharmaceutical composition comprising
   (i) the composition according to claim 1; and
   (ii) optionally a pharmaceutically acceptable carrier or excipient.

6. The composition of claim 1, wherein
   i) the first protective protein consists of the amino acid sequence of SEQ ID NO: 4 (gbs1477p); and
   ii) the second protective protein consists of the amino acid sequence of SEQ ID NO: 5 (gbs1478p).

7. A pharmaceutical composition comprising
   (i) the composition according to claim 2; and
   (ii) optionally a pharmaceutically acceptable carrier or excipient.

8. A pharmaceutical composition comprising
   (i) the composition according to claim 3; and
   (ii) optionally a pharmaceutically acceptable carrier or excipient.

9. The pharmaceutical composition of claim 5, further comprising an immunostimulatory substance.

10. The pharmaceutical composition of claim 9, wherein the immunostimulatory substance is an adjuvant.

11. The pharmaceutical composition of claim 7, further comprising an immunostimulatory substance.

12. The pharmaceutical composition of claim 11, wherein the immunostimulatory substance is an adjuvant.

13. The pharmaceutical composition of claim 8, further comprising an immunostimulatory substance.

14. The pharmaceutical composition of claim 13, wherein the immunostimulatory substance is an adjuvant.

15. A method of inducing an immune response in a subject comprising administering an effective amount of the composition according to claim 1 to said subject.

* * * * *